United States Patent
Obermajer et al.

(10) Patent No.: US 11,827,708 B2
(45) Date of Patent: Nov. 28, 2023

(54) PROTEINS COMPRISING HLA-G ANTIGEN BINDING DOMAINS AND THEIR USES

(71) Applicant: Janssen Biotech, Inc., Horsham, PA (US)

(72) Inventors: Natasa Obermajer, Antwerp (BE); Adam Zwolak, Bala Cynwyd, PA (US); Sylvie Laquerre, Chesterbrook, PA (US); Dirk Brehmer, Beerse (BE); Desiree De Lange, Antwerp (BE); Julien Häsler, Hoogstrten (BE); Shana Versmissen, Beerse (BE); Theodore D. Petley, Honey Brook, PA (US); Kelly van de Ven, Noord Brabant (NL); Fang Yi, Collegeville, PA (US); Sanjaya Singh, Blue Bell, PA (US); Rajkumar Ganesan, Blue Bell, PA (US)

(73) Assignee: Janssen Biotech, Inc., Horsham, PA (US)

( * ) Notice: Subject to any disclaimer, the term of this patent is extended or adjusted under 35 U.S.C. 154(b) by 131 days.

(21) Appl. No.: 17/388,056

(22) Filed: Jul. 29, 2021

(65) Prior Publication Data
US 2022/0033505 A1 Feb. 3, 2022

Related U.S. Application Data

(60) Provisional application No. 63/057,960, filed on Jul. 29, 2020.

(51) Int. Cl.
*C07K 16/28* (2006.01)
*A61P 35/00* (2006.01)
*A61K 39/00* (2006.01)

(52) U.S. Cl.
CPC .......... *C07K 16/2833* (2013.01); *A61P 35/00* (2018.01); *C07K 16/2809* (2013.01); *A61K 2039/505* (2013.01); *A61K 2039/545* (2013.01); *C07K 2317/31* (2013.01); *C07K 2317/55* (2013.01); *C07K 2317/622* (2013.01)

(58) Field of Classification Search
None
See application file for complete search history.

(56) References Cited

U.S. PATENT DOCUMENTS

| | | | |
|---|---|---|---|
| 4,683,195 A | 7/1987 | Mullis et al. | |
| 5,225,539 A | 7/1993 | Winter | |
| 5,635,483 A | 6/1997 | Pettit et al. | |
| 5,780,588 A | 7/1998 | Pettit et al. | |
| 5,932,448 A | 8/1999 | Tso et al. | |
| 6,150,584 A | 11/2000 | Kucherlapati et al. | |
| 6,255,458 B1 | 7/2001 | Lonberg et al. | |
| 6,790,638 B1 | 9/2004 | Carosella et al. | |
| 6,818,749 B1 | 11/2004 | Kashmiri et al. | |
| 6,833,441 B2 | 12/2004 | Wang et al. | |
| 7,709,226 B2 | 5/2010 | Foote | |
| 9,150,663 B2 | 10/2015 | Labrijn et al. | |
| 2007/0287170 A1 | 12/2007 | Davis et al. | |
| 2010/0076178 A1 | 3/2010 | Ghayer et al. | |
| 2010/0261620 A1 | 10/2010 | Almagro et al. | |
| 2012/0149876 A1 | 6/2012 | Von Kreudenstein et al. | |
| 2013/0195849 A1 | 8/2013 | Von Kreudenstein et al. | |
| 2014/0273092 A1 | 9/2014 | Flikweert et al. | |
| 2014/0303356 A1 | 10/2014 | Gramer et al. | |
| 2018/0118849 A1 | 5/2018 | Klein et al. | |
| 2020/0102389 A1 | 4/2020 | Fischer et al. | |

FOREIGN PATENT DOCUMENTS

| | | |
|---|---|---|
| EP | 0590058 B1 | 11/2003 |
| FR | 2775189 | 8/1999 |
| WO | WO 1990/04036 A1 | 4/1990 |
| WO | WO 1990/007861 A1 | 7/1990 |
| WO | WO 1992/22653 A1 | 12/1992 |
| WO | WO 1996/027011 A1 | 9/1996 |
| WO | WO 1999/45962 A1 | 9/1999 |
| WO | WO 2002/043478 A2 | 6/2002 |
| WO | WO 2002/066630 A1 | 8/2002 |
| WO | WO 2002/088172 A2 | 11/2002 |
| WO | WO 2007/147901 A1 | 12/2007 |
| WO | WO 2008/077546 A1 | 7/2008 |
| WO | WO 2009/085462 A1 | 7/2009 |
| WO | WO 2009/134776 A2 | 11/2009 |
| WO | WO 2011/143545 A1 | 11/2011 |
| WO | WO 2012/022811 A1 | 2/2012 |
| WO | WO 2013/096291 A2 | 6/2013 |
| WO | WO 2013/157954 A1 | 10/2013 |
| WO | WO 2014/093908 A2 | 6/2014 |
| WO | WO 2019/060695 A1 | 3/2019 |

(Continued)

OTHER PUBLICATIONS

Baert et al., "Influence of Immunogenicity on the Long-Term Efficacy of Infliximab in Crohn's Disease.", N. Engl. J. Med, 2003, pp. 602-608, vol. 348(7).

Cai et al., "C-Terminal Lysine Processing of Human Immunoglobulin G2 Heavy Chain In Vivo.", Biotechnol Bioeng, Feb. 2011, pp. 404-412, vol. 108(2).

Carosella et al., "Beyond the increasing complexity of the immunomodulatory HLA-G molecule.", Blood, 2008, pp. 4862-4870, vol. 111, doi:10.1182/blood-2007-12-127662.

Carosella et al., "HLA-G: An Immune Checkpoint Molecule.", Adv Immunol, 2015, pp. 33-144, vol. 127, doi:10.1016/bs.ai.2015.04.001.

Chothia and Lesk, "Canonical Structures for the Hypervariable Regions of Immunoglobulins.", Mol Biol, 1987, pp. 901-917, vol. 196.

(Continued)

*Primary Examiner* — Laura B Goddard
*Assistant Examiner* — Sarah A Alsomairy
(74) *Attorney, Agent, or Firm* — Jason Galvez

(57) ABSTRACT

The invention provides antigen binding domains that bind human leukocyte antigen G (HLA-G) protein comprising the antigen binding domains that bind HLA-G, polynucleotides encoding them, vectors, host cells, methods of making and using them.

28 Claims, 20 Drawing Sheets

Specification includes a Sequence Listing.

(56) References Cited

FOREIGN PATENT DOCUMENTS

| WO | WO 2019/202041 | 10/2019 | |
|---|---|---|---|
| WO | WO-2019202041 A1 * | 10/2019 | ............. A61P 35/00 |

OTHER PUBLICATIONS

Clements et al. "Crystal structure of HLA-G: a nonclassical MHC class I molecule expressed at the fetal-maternal interface.", Proc Natl Acad Sci USA , 2005, pp. 3360-3365, vol. 102, doi:10.1073/pnas.0409676102.

Dong et al., "B7-H1 pathway and its role in the evasion of tumor immunity.", J Mol Med, 2003, pp. 281-287, vol. 81.

Fairhead & Howarth, "Site-specific biotinylation of purified proteins using BirA.", Methods Mol Biol, Jul. 1, 2015, 1266:171-184.

Ferrara et al., "Modulation of Therapeutic Antibody Effector Functions by Glycosylation Engineering: Influence of Golgi Enzyme Localization Domain and Co-Expression of Heterologous β1,4-N-acetylglucosaminyltransferase III and Golgi α-mannosidase II.", Biotechnol Bioeng, 2006, pp. 851-861, vol. 93.

Ferrara et al., "The Carbohydrate at FcγRIIIa Asn-162. An Element Required for High Affinity Binding to Non-Fuscosylated IgG Glycoforms*.", J Biol Chem, 2006, pp. 5032-5036, vol. 281(8).

Honegger and Plückthun, "Yet Another Numbering Scheme for Immunoglobin Variable Domains: An Automatic Modeling and Analysis Tool.", J Mol Biol, 2001, pp. 657-670, vol. 309.

Juch et al., "A novel sandwich ELISA for alpha1 domain based detection of soluble HLA-G heavy chains.", J Immunol Methods, 2005, pp. 96-106, vol. 307, doi:10.1016/j.jim.2005.09.016.

Kim et al., "Heterodimeric CD3eg Extracellular Domain Fragments: Production, Purification and Structural Analysis." J Mol. Biol., 2000, pp. 899-916, vol. 302(4).

Kjer-Nielsen et al., "Crystal structure of the human T cell receptor CD3εγ heterodimer complexed to the therapeutic mAb OKT3.", Proc Natl Acad Sci USA, May 18, 2004, pp. 7675, vol. 101(20).

Knappik et al., "Fully Snythetic Human Combinatorial Antibody Libraries (HuCAL) Based on Modular Consensus Frameworks and CDRs Randomized with Trinucleotides.", J Mol Biol, 2000, pp. 57-86, vol. 296.

Konno et al., "Fucose content of monoclonal antibodies can be controlled by culture medium osmolality for high antibody-dependent cellular cytotoxicity.", Cytotechnology, 2012, pp. 249-265, vol. 64.

Lee et al. "The membrane-bound and soluble forms of HLA-G bind identical sets of endogenous peptides but differ with respect to TAP association.", 1995, Immunity, pp. 591-600, vol. 3, doi:10.1016/1074-7613(95)90130-2.

Lefranc et al., "IMGT unique numbering for immunoglobulin and T cell receptor variable domains and Ig superfamily V-like domains.", Dev Comparat Immunol, 2003, pp. 55-77, vol. 27.

MacLennan et al., "Structure-Function Relationships in the Ca2+-Binding and Translocation Domain of SERCA1: physiological correlates in Brody disease.", Acta Physiol Scand, 1998, pp. 55-67, Suppl 643.

Martin and Thornton, "Structural Families in Loops of Homologous Proteins: Automatic Classification, Modelling and Application to Antibodies.", J Bmol Biol, 1996, pp. 800-815, vol. 263.

Mori et al., "Engineering Chinese Hamster Ovary Cells to Maximize Effector Function of Produced Antibodies Using FUT8 siRNA.", Biotechnol Bioeng, 2004, pp. 901-908, vol. 88(7).

Olivier et al., "EB66 cell line, a duck embryonic stem cell-derived substrate for the industrial production of therapeutic monoclonal antibodies with enhanced ADCC activity.", Mabs, 2010, pp. 405-415, vol. 2(4).

Osborn et al., High-Affinity IgG Antibodies Develop Naturally in Ig-Knockout Rats Carrying Germline Human IgH/Igk/Igl Loci Bearing the Rat $C_H$ Region, J. Immunol., Jan. 2013, pp. 1481-1490, vol. 190(4).

Padlan, E., "A Possible Procedure for Reducing the Immunogenicity of Antibody Variable Domains While Preserving Their Ligand-Binding Properties.", Mol Immunol, 1991, pp. 489-499, vol. 28(4/5).

Schneider et al., "Characterization of EBV-genome negative "null" and "T" cell lines derived from children with acute lymphoblastic leukemia and leukemic transformed non-Hodgkin lymphoma.", Int. J. Cancer, 1977, pp. 621-626, vol. 19(5).

Shi et al., "De Novo Selection of High-Affinity Antibodies from Synthetic Fab Libraries Displayed on Phage as pIX Fusion Proteins.", J Mol Biol, 2010, pp. 385-396, vol. 397.

Shields et al., "Lack of fucose on human IgG1 N-linked oligosaccharide improves binding to human Fcgamma RIII and antibody-dependent cellular toxicity.", J Biol Chem, 2002, pp. 26733-26740, vol. 277, doi:10.1074/jbc.M202069200 (2002).

Shinkawa et al., "The Absence of Fucose but Not the Presence of Galactose or Bisecting N-Acetylglucosamine of Human IgG1 Complex-type Oligosaccharides Shows the Critical Role of Enhancing Antibody-dependent Cellular Cytotoxicity*.", J Biol Chem, 2003, pp. 3466-3473, vol. 278.

Stickler et al., "The human G1m1 allotype associates with CD4+ T-cell responsiveness to a highly conserved IgG1 constant region peptide and confers an asparaginyl endopeptidase cleavage site.", Genes and Immunity, 2011, pp. 213-221, vol. 12.

Ward et al., "Binding activities of a repertoire of single immunoglobulin variable domains secreted from *Escherichia coil*.", Nature, 1989, pp. 544-546, vol. 341.

Wilky, B. A., "Immune checkpoint inhibitors: The linchpins of modern immunotherapy.", Immunol Rev, 2019, pp. 6-23, vol. 290.

Woyke et al., "In Vitro Activities and Postantifungal Effects of the Potent Dolastatin 10 Derivative Auristatin PHE.", Antimicrob Agents and Chemother., Dec. 2001, pp. 3580-3584, vol. 45(12).

Wu and Kabat, "An Analysis of the Sequences of the Variable Regions of Bence Jones Proteins and Myeloma Light Chains and Their Implications for Anti-body Complementarity*.", J Exp Med, 1970, pp. 211-250, vol. 132.

Zhou et al., "Development of a simple and rapid method for producing non-fucosylated oligomannose containing antibodies with increased effector function.", Biotechnol Bioeng, 2008, pp. 652-665, vol. 99.

Zhang, D. et al. Functional optimization of agonistic antibodies to OX40 receptor with novel Fc mutations to promote antibody multimerization. MAbs 9, 1129-1142, doi:10.1080/19420862.2017.1358838 (2017).

* cited by examiner

Figure 13.

```
CD3B815  DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK
CD3W244  DIQMTQSPSSLSASVGDRVTITCRARQSIGTAIHWYQQKPGKAPKLLIYYASESISGVPSRFSGSGSGTDFTLTISSLQPEDFATYYCQQSSSWPYTFGQGTKLEIK
CD3W245  DIQMTQSPSSLSASVGDRVTITCRARQSIGTAIHWYQQKPGKAPKLLIYYASESISGVPSRFSGSGSGTDFTLTISSLQPEDFATYYCQQSSSWPYTFGQGTKLEIK
CD3W246  DIQMTQSPSSLSASVGDRVTITCRARQSIGTAIHWYQQKPGKAPKLLIYYASESISGVPSRFSGSGSGTDFTLTISSLQPEDFATYYCQQSSSWPYTFGQGTKLEIK
CD3W247  DIQMTQSPSSLSASVGDRVTITCRARQSIGTAIHWYQQKPGKAPKLLIYYASESISGVPSRFSGSGSGTDFTLTISSLQPEDFATYYCQQSSSWPYTFGQGTKLEIK
CD3W248  DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK
         *::*:***. ***:*::   .***::*: *********** ..* ** ******:.****************::.*:**:**:****:.*****.******
```

VL consensus sequence (SEQ ID NO: 374)

```
DIQX1TQSPX2X3LSX4X5X6GX7RVX8X9X10CRARQSIGTAIHWYQQKX11X12X13X14PX15LLIX16X17YASESISGX18X19PSRFSGSGSGTDFTLTIX20X21X22X23EDX24AX25YY
CQQSX26X27SWPYTFGX28X29GTKLEIK; wherein
```

X1 is L or M;
X2 is G or S;
X3 is I or S;
X4 is V or A;
X5 is P or V;
X6 is E or D;
X7 is S or T;
X8 is F or I;
X9 is S or T;
X10 is T or P;
X11 is N or G;
X12 is G or K;
X13 is S or A;
X14 is R or K;
X15 is K or Y;
X16 is I or V;
X17 is N or S;
X18 is V or L;
X19 is S or P;
X20 is I or F;
X21 is D or T;
X22 is N or G; or
X23 is G or Q.

PROTEINS COMPRISING HLA-G ANTIGEN BINDING DOMAINS AND THEIR USES

CROSS REFERENCE TO RELATED APPLICATIONS

This application claims priority to U.S. Provisional Application Ser. No. 63/057,960, filed Jul. 29, 2020. The disclosure of each of the aforementioned applications is incorporated herein by reference in its entirety.

SEQUENCE LISTING

The instant application contains a Sequence Listing which has been submitted electronically in ASCII format and is hereby incorporated by reference in its entirety. Said ASCII copy, created on Jul. 12, 2021, is named JBI6358USNP_SL.txt and is 747 KB in size.

TECHNICAL FIELD

The disclosure provides proteins comprising antigen binding domains that bind human leukocyte antigen G (HLA-G) protein, polynucleotides encoding them, vectors, host cells, methods of making and using them.

BACKGROUND

The human leukocyte antigen G (HLA-G) belongs to the non-classical MHC class Ib family of proteins. Seven alternative mRNAs were described, which encode four membrane bound (HLA-G1, G2, G3, G4) and three soluble (HLA-G5, G6, G7) protein isoforms (Carosella et al., 2003). In contrast to high polymorphic classical HLA class I genes, HLA-G gene polymorphism is very limited. Only 50 alleles are listed for HLA-G encoding 16 full-length proteins. The HLA-G1 and its soluble counterpart HLA-G5 have an identical extracellular structure, which is classical HLA class I-like: a heavy chain of three globular domains non-covalently bound to beta-2-microglobulin (β2m) and suitable to bind restricted peptides such as histone H2A peptide[1-3]. The HLA-G1 monomer differs from classical HLA-class I molecules at the level of its peptide-binding groove (a key structural element to the activating functions of HLA molecules) and its α3 domain (a key structural element to the inhibitory functions of HLA-class I molecules). Proteolytic shedding of membrane isoform(s) additionally creates soluble molecules (Dong et al., 2003; Park et al., 2004). Monomers, homo- and possible hetero-multimers, and ubiquitinated proteins have been reported structures for HLA-G. The inhibitory function of HLA-G is thought to be mostly due to dimers, not monomers, to block the human inhibitory receptors 1g-like transcript 2 and 4 (ILT2 and ILT4) as the best characterized receptors. HLA-G1 homodimers take an oblique orientation that exposes the ILT2- and ILT4-binding sites of the α3 domain and thereby bind with a higher affinity and slower dissociation rates than HLA-G monomers.

The known receptors for HLA-G include inhibitory receptors ILT2 (expressed on monocytes, DCs, B cells, and subsets of natural killer and T cells,) and ILT4 (exclusively expressed by cells of the myelomonocytic lineage)—the main HLA-G receptors on peripheral immune cells (Colonna et al., 1997, 1998)-, non-inhibitory receptors CD8 and CD160, and the KIR2DL4 receptor which status remains ambiguous with respect to HLA-G. ILT2 and ILT4 recognize and bind to the α3 domain and β2m of MHCIs.

Most of the functions described for HLA-G are immune functions, although non-immune functions have also been reported, such as inhibiting angiogenesis and osteogenesis. HLA-G-ILT2 interaction was repeatedly shown to inhibit NK cell functions, thus protecting the HLA-G-expressing cells from NK-mediated cytolysis. Further, the function of ILT-2 expressing T cells (activated and/or clonal T cells) and B cells is directly inhibited by HLA-G. HLA-G also induces an alternate differentiation in myeloid APCs, induces the differentiation of regulatory myeloid cells and regulatory T cells, and inhibits phagocytic function of neutrophils.

This immunosuppressive capability of HLA-G to inhibit signaling pathways required for NK mediated cytolysis, T-cell proliferation and induction of regulatory/suppressor cells, and thereby to evade the immune system can be exploited by tumor cells to escape immune surveillance leading to uncontrolled growth of cells with higher invasive and metastatic abilities. HLA-G is not only capable of evading host immune surveillance but also enhances the metastasis during the progression of malignancies. Numerous studies have demonstrated tumoral HLA-G expression (not in the normal surrounding zones) that could be correlated with disease stage or worsening patient outcome. HLA-G expression has been implicated in tumor evolution and progression as well as advanced tumor stage, higher invasive and metastatic abilities and poor clinical prognosis. Its aberrant expression was associated with decreased survival time.

While various cancers show expression of HLA-G, the expression in normal tissues is mainly restricted to the fetal-maternal interface on the extravillous cytotrophoblast, to the placenta, to the amnion, and to specific healthy adult tissues such as thymus, cornea, bronchial epithelial cells, pancreas and specific types of cells such as mesenchymal stem cells, activated monocytes, erythroid and endothelial precursors (reviewed in Carosella et al., 2015).

Bearing in mind its potent and broad immune-suppressive functional role and restricted expression pattern in normal tissues, HLA-G may be designated as an attractive therapeutic target in solid tumors and B-cell malignancies over-expressing HLA-G.

Of the few specific anti-HLA-G antibodies that have been generated only the following available antibodies bind native cell-expressed HLA-G (87G, MEM-G9, MEM-Gil, G223). The percentage of inhibition of HLA-G interaction with ligands ILT-2 and/or ILT-4 with these antibodies is not complete even at high dose of the respective antibody. Further, even though it has been described that in particularly 87G antibody is capable of enhancing tumor killing in vitro, there is no report of the efficacy of blocking HLA-G by administering the antibody in vivo.

There is a need for next generation HLA-G binding domains for therapeutic and diagnostic purposes.

SUMMARY

The present invention provides specific anti-HLA-G monoclonal antibodies that strongly block the binding between HLA-G and its cognate receptors ILT-2 and/or ILT-4. The generated anti-HLA-G antibodies bind either recombinant or endogenous HLA-G proteins in the absence of cross-reactivity with classical MHC class I molecules. The antibodies of the invention are the first HLA-G-specific antibodies to our knowledge to demonstrate the specificity to HLA-G and no cross-reactivity with HLA-A, HLA-B, HLA-C, and HLA-E; and/or complete blocking of HLA-G interaction with ILT-2/4 ligands. Additionally, the antibodies of the invention demonstrated the tumor growth inhibition following in vivo administration.

The invention also relates to the use of such antibodies or proteins comprising variable domains derived from these antibodies, in order to eliminate tumor cells with elevated expression of HLA-G on the surface by engaging the immune system, either by blocking the interaction of HLA-G with immune-suppressive ligands or by Fc- or bispecific protein-mediated recruiting of immune cells. Accordingly, the antibodies are suitable to treat or alleviate a condition diagnosed in patients, when said condition takes advantage of the induced expression of HLA-G in a patient.

The disclosure provides an isolated protein comprising an antigen binding domain that binds human leukocyte antigen G (HLA-G), wherein the antigen binding domain that binds HLA-G comprises
- a) a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or
- b) the HCDR1, the HCDR2 and the HCDR3 of the VH of SEQ ID NO: 52 and the LCDR1, the LCDR2 and the LCDR3 of the VL of SEQ ID NO: 53; or
- c) the HCDR1, the HCDR2 and the HCDR3 of the VH of SEQ ID NO: 54 and the LCDR1, the LCDR2 and the LCDR3 of the VL of SEQ ID NO: 55; or
- d) the HCDR1, the HCDR2 and the HCDR3 of the VH of SEQ ID NO: 56 and the LCDR1, the LCDR2 and the LCDR3 of the VL of SEQ ID NO: 57; or
- e) the HCDR1, the HCDR2 and the HCDR3 of the VH of SEQ ID NO: 58 and the LCDR1, the LCDR2 and the LCDR3 of the VL of SEQ ID NO: 59; or
- f) the HCDR1, the HCDR2 and the HCDR3 of the VH of SEQ ID NO: 60 and the LCDR1, the LCDR2 and the LCDR3 of the VL of SEQ ID NO: 61; or
- g) the HCDR1, the HCDR2 and the HCDR3 of the VH of SEQ ID NO: 62 and the LCDR1, the LCDR2 and the LCDR3 of the VL of SEQ ID NO: 63; or
- h) the HCDR1, the HCDR2 and the HCDR3 of the VH of SEQ ID NO: 64 and the LCDR1, the LCDR2 and the LCDR3 of the VL of SEQ ID NO: 65; or
- i) the HCDR1, the HCDR2 and the HCDR3 of the VH of SEQ ID NO: 66 and the LCDR1, the LCDR2 and the LCDR3 of the VL of SEQ ID NO: 67; or
- j) the HCDR1, the HCDR2 and the HCDR3 of the VH of SEQ ID NO: 68 and the LCDR1, the LCDR2 and the LCDR3 of the VL of SEQ ID NO: 69.

In certain embodiments, the isolated protein comprises the HCDR1, the HCDR2, the HCDR3, the LCDR1, the LCDR2 and the LCDR3 of
- a) SEQ ID NOs: 70, 71, 72, 88, 89, and 90, respectively;
- b) SEQ ID NOs: 73, 71, 74, 91, 89, and 92, respectively;
- c) SEQ ID NOs: 75, 76, 77, 93, 89, and 94, respectively;
- d) SEQ ID NOs: 78, 79, 80, 95, 89, and 96, respectively;
- e) SEQ ID NOs: 81, 82, 83, 97, 89, and 98, respectively;
- f) SEQ ID NOs: 78, 71, 84, 99, 89, and 100, respectively;
- g) SEQ ID NOs: 78, 71, 84, 101, 89, and 100, respectively;
- h) SEQ ID NOs: 85, 86, 87, 102, 103, and 104, respectively; or
- i) SEQ ID NOs: 78, 71, 84, 95, 89, and 96, respectively.

In certain embodiments, the antigen binding domain that binds HLA-G is a scFv, a (scFv)2, a Fv, a Fab, a F(ab')2, a Fd, a dAb or a VHH.

In other embodiments, the antigen binding domain that binds HLA-G is the Fab.

In other embodiments, the antigen binding domain that binds HLA-G is the VHH.

In other embodiments, the antigen binding domain that binds HLA-G is the scFv.

In other embodiments, the scFv comprises, from the N- to C-terminus, a VH, a first linker (L1) and a VL (VH-L1-VL) or the VL, the L1 and the VH (VL-L1-VH).

In certain embodiments, the L1 comprises
- a) about 5-50 amino acids;
- b) about 5-40 amino acids;
- c) about 10-30 amino acids; or
- d) about 10-20 amino acids.

In certain embodiments, the L1 comprises an amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

In certain embodiments, the L1 comprises the amino acid sequence of SEQ ID NO: 8.

In other embodiments, the antigen binding domain that binds HLA-G comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

In other embodiments, the antigen binding domain that binds HLA-G comprises:
- a) the VH of SEQ ID NO: 50 and the VL of SEQ ID NO: 51;
- b) the VH of SEQ ID NO: 52 and the VL of SEQ ID NO: 53;
- c) the VH of SEQ ID NO: 54 and the VL of SEQ ID NO: 55;
- d) the VH of SEQ ID NO: 56 and the VL of SEQ ID NO: 57;
- e) the VH of SEQ ID NO: 58 and the VL of SEQ ID NO: 59;
- f) the VH of SEQ ID NO: 60 and the VL of SEQ ID NO: 61;
- g) the VH of SEQ ID NO: 62 and the VL of SEQ ID NO: 63;
- h) the VH of SEQ ID NO: 64 and the VL of SEQ ID NO: 65;
- i) the VH of SEQ ID NO: 66 and the VL of SEQ ID NO: 67; or
- j) the VH of SEQ ID NO: 68 and the VL of SEQ ID NO: 69;

In other embodiments, the antigen binding domain that binds HLA-G comprises the amino acid sequence of SEQ ID NOs: 265, 248, 249, 250, 251, 252, 253, 254, 255, 256, 257, 258, 259, 260, 261, 262, 263, 264, 266, 267, 268, or 269.

In other embodiments, the protein of the disclosure is conjugated to a half-life extending moiety.

In other embodiments, the half-life extending moiety is an immunoglobulin (Ig), a fragment of the Ig, an Ig constant region, a fragment of the Ig constant region, a Fc region, transferrin, albumin, an albumin binding domain or polyethylene glycol.

In other embodiments, the isolated protein is a monospecific protein.

In other embodiments, the isolated protein is a multispecific protein.

In other embodiments, the multispecific protein is a bispecific protein.

In other embodiments, the multispecific protein is a trispecific protein.

In other embodiments, the isolated protein of the disclosure further comprises an immunoglobulin (Ig) constant region or a fragment of the Ig constant region thereof.

In other embodiments, the fragment of the Ig constant region comprises a Fc region.

In other embodiments, the fragment of the Ig constant region comprises a CH2 domain.

In other embodiments, the fragment of the Ig constant region comprises a CH3 domain.

In other embodiments, the fragment of the Ig constant region comprises the CH2 domain and the CH3 domain.

In other embodiments, the fragment of the Ig constant region comprises at least portion of a hinge, the CH2 domain and the CH3 domain.

In other embodiments, the fragment of the Ig constant region comprises a hinge, the CH2 domain and the CH3 domain.

In other embodiments, the antigen binding domain that binds HLA-G is conjugated to the N-terminus of the Ig constant region or the fragment of the Ig constant region.

In other embodiments, the antigen binding domain that binds HLA-G is conjugated to the C-terminus of the Ig constant region or the fragment of the Ig constant region.

In other embodiments, the antigen binding domain that binds HLA-G is conjugated to the Ig constant region or the fragment of the Ig constant region via a second linker (L2).

In other embodiments, the L2 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

In other embodiments, the multispecific protein comprises an antigen binding domain that binds an antigen on a lymphocyte.

In other embodiments, the lymphocyte is a T cell.

In other embodiments, the T cell is a CD8+ T cell

In other embodiments, the lymphocyte is a natural killer (NK) cell.

In other embodiments, the multispecific protein comprises an antigen binding domain that binds CD3, CD3 epsilon (CD3ε), CD8, KI2L4, NKG2E, NKG2D, NKG2F, BTNL3, CD186, BTNL8, PD-1, CD195, or NKG2C.

In other embodiments, the multispecific protein comprises an antigen binding domain that binds CD3ε.

In other embodiments, the antigen binding domain that binds CD3ε comprises:
  a) a heavy chain complementarity determining region 1 (HCDR1) of SEQ ID NO: 361, a HCDR2 of SEQ ID NO: 362, a HCDR3 of SEQ ID NO: 363, a light chain complementarity determining region 1 (LCDR1) of SEQ ID NO: 367, a LCDR2 of SEQ ID NO: 368 and a LCDR3 of SEQ ID NO: 369;
  b) the VH of SEQ ID NO: 339 and the VL of SEQ ID NO: 340;
  c) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 370;
  d) the VH of SEQ ID NO: 339 and the VL of SEQ ID NO: 341;
  e) the VH of SEQ ID NO: 339 and the VL of SEQ ID NO: 342;
  f) the VH of SEQ ID NO: 339 and the VL of SEQ ID NO: 343;
  g) the VH of SEQ ID NO: 339 and the VL of SEQ ID NO: 344;
  h) the VH of SEQ ID NO: 339 and the VL of SEQ ID NO: 345;
  i) the HCDR1 of SEQ ID NO: 364, the HCDR2 of SEQ ID NO: 365, the HCDR3 of SEQ ID NO: 366, the LCDR1 of SEQ ID NO: 371, the LCDR2 of SEQ ID NO: 372 and the LCDR3 of SEQ ID NO: 373;
  j) the VH of SEQ ID NO: 346 and the VL of SEQ ID NO: 347; or
  k) the VH of SEQ ID NO: 348 and the VL of SEQ ID NO: 349.

In other embodiments, the Ig constant region or the fragment of the Ig constant region is an IgG1, an IgG2, an IgG3 or an IgG4 isotype.

In other embodiments, the Ig constant region or the fragment of the Ig constant region comprises at least one mutation that results in reduced binding of the protein to a Fcγ receptor (FcγR).

In other embodiments, the at least one mutation that results in reduced binding of the protein to the FcγR is selected from the group consisting of L235A/D265S, F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

In other embodiments, the Ig constant region or the fragment of the Ig constant region comprises at least one mutation that results in enhanced binding of the protein to the FcγR.

In other embodiments, the at least one mutation that results in enhanced binding of the protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

In other embodiments, the FcγR is FcγRI, FcγRIIA, FcγRIIB or FcγRIII, or any combination thereof.

In other embodiments, the Ig constant region of the fragment of the Ig constant region comprises at least one mutation that modulates a half-life of the protein.

In other embodiments, the at least one mutation that modulates the half-life of the protein is selected from the group consisting of H435A, P257I/N434H, D376V/N434H, M252Y/S254T/T256E/H433K/N434F, T308P/N434A and H435R, wherein residue numbering is according to the EU index.

In other embodiments, the protein comprises at least one mutation in a CH3 domain of the Ig constant region.

In other embodiments, the at least one mutation in the CH3 domain of the Ig constant region is selected from the group consisting of T350V, L351Y, F405A, Y407V, T366Y, T366W, F405W, T394W, T394S, Y407T, Y407A, T366S/L368A/Y407V, L351Y/F405A/Y407V, T366I/K392M/T394W, F405A/Y407V, T366L/K392M/T394W, L351Y/Y407A, T366A/K409F, L351Y/Y407A, T366V/K409F, T366A/K409F, T350V/L351Y/F405A/Y407V and T350V/T366L/K392L/T394W, wherein residue numbering is according to the EU index.

In certain embodiments, the disclosure provides an isolated multispecific protein comprising a first antigen binding domain that binds HLA-G and a second antigen binding domain that binds a lymphocyte antigen.

In other embodiments, the lymphocyte antigen is a T cell antigen.

In other embodiments, the T cell antigen is a CD8+ T cell antigen.

In other embodiments, the lymphocyte antigen is a NK cell antigen.

In other embodiments, the lymphocyte antigen is CD3, CD3 epsilon (CD3ε), CD8, KI2L4, NKG2E, NKG2D, NKG2F, BTNL3, CD186, BTNL8, PD-1, CD195, or NKG2C.

In other embodiments, the lymphocyte antigen is CD3ε.

In other embodiments, the first antigen binding domain that binds HLA-G and/or the second antigen binding domain that binds the lymphocyte antigen comprise a scFv, a (scFv)2, a Fv, a Fab, a F(ab')2, a Fd, a dAb or a VHH.

In other embodiments, the first antigen binding domain that binds HLA-G and/or the second antigen binding domain that binds the lymphocyte antigen comprise the Fab.

In other embodiments, the first antigen binding domain that binds HLA-G and/or the second antigen binding domain that binds the lymphocyte antigen comprise the VHH.

In other embodiments, the first antigen binding domain that binds HLA-G and/or the second antigen binding domain that binds the lymphocyte antigen comprise the scFv.

In other embodiments, the scFv comprises, from the N- to C-terminus, a VH, a first linker (L1) and a VL (VH-L1-VL) or the VL, the L1 and the VH (VL-L1-VH).

In other embodiments, the L1 comprises
a) about 5-50 amino acids;
b) about 5-40 amino acids;
c) about 10-30 amino acids; or
d) about 10-20 amino acids.

In other embodiments, the L1 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

In other embodiments, the L1 comprises the amino acid sequence of SEQ ID NO: 8.

In other embodiments, the first antigen binding domain that binds HLA-G comprises the HCDR1 of SEQ ID NOs: 70, 73, 75, 78, 81, or 85, the HCDR2 of SEQ ID NOs: 71, 76, 79, 82, or 86, the HCDR3 of SEQ ID NOs: 72, 74, 77, 80, 83, 84, or 87, the LCDR1 of SEQ ID NOs: 88, 91, 93, 95, 97, 99, 101, or 102, the LCDR2 of SEQ ID NOs: 89 or 103, and the LCDR3 of SEQ ID NOs: 90, 92, 94, 96, 98, 100, or 104.

In other embodiments, the first antigen binding domain that binds HLA-G comprises the HCDR1, the HCDR2, the HCDR3, the LCDR1, the LCDR2 and the LCDR3 of
a) SEQ ID NOs: 70, 71, 72, 88, 89, and 90, respectively;
b) SEQ ID NOs: 73, 71, 74, 91, 89, and 92, respectively;
c) SEQ ID NOs: 75, 76, 77, 93, 89, and 94, respectively;
d) SEQ ID NOs: 78, 79, 80, 95, 89, and 96, respectively;
e) SEQ ID NOs: 81, 82, 83, 97, 89, and 98, respectively;
f) SEQ ID NOs: 78, 71, 84, 99, 89, and 100, respectively;
g) SEQ ID NOs: 78, 71, 84, 101, 89, and 100, respectively;
h) SEQ ID NOs: 85, 86, 87, 102, 103, and 104, respectively; or
i) SEQ ID NOs: 78, 71, 84, 95, 89, and 96, respectively.

In other embodiments, the first antigen binding domain that binds HLA-G comprises
a) the VH of SEQ ID NO: 50 and the VL of SEQ ID NO: 51;
b) the VH of SEQ ID NO: 52 and the VL of SEQ ID NO: 53;
c) the VH of SEQ ID NO: 54 and the VL of SEQ ID NO: 55;
d) the VH of SEQ ID NO: 56 and the VL of SEQ ID NO: 57;
e) the VH of SEQ ID NO: 58 and the VL of SEQ ID NO: 59;
f) the VH of SEQ ID NO: 60 and the VL of SEQ ID NO: 61;
g) the VH of SEQ ID NO: 62 and the VL of SEQ ID NO: 63;
h) the VH of SEQ ID NO: 64 and the VL of SEQ ID NO: 65;
i) the VH of SEQ ID NO: 66 and the VL of SEQ ID NO: 67; or
j) the VH of SEQ ID NO: 68 and the VL of SEQ ID NO: 69.

In other embodiments, the first antigen binding domain that binds HLA-G comprises the VH of SEQ ID NOs: 50, 52, 54, 56, 58, 60, 62, 64, 66, or 68, and the VL of SEQ ID NOs: 51, 53, 55, 57, 59, 61, 63, 65, 67, or 69.

In other embodiments, the first antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

In other embodiments, the second antigen binding domain that binds the lymphocyte antigen comprises
a) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 369;
b) the VH of SEQ ID NO: 339 and the VL of SEQ ID NO: 340;
c) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 370;
d) the VH of SEQ ID NO: 339 and the VL of SEQ ID NO: 341;
e) the VH of SEQ ID NO: 339 and the VL of SEQ ID NO: 342;
f) the VH of SEQ ID NO: 339 and the VL of SEQ ID NO: 343;
g) the VH of SEQ ID NO: 339 and the VL of SEQ ID NO: 344;
h) the VH of SEQ ID NO: 339 and the VL of SEQ ID NO: 345;
i) the HCDR1 of SEQ ID NO: 364, the HCDR2 of SEQ ID NO: 365, the HCDR3 of SEQ ID NO: 366, the LCDR1 of SEQ ID NO: 371, the LCDR2 of SEQ ID NO: 372 and the LCDR3 of SEQ ID NO: 373;
j) the VH of SEQ ID NO: 346 and the VL of SEQ ID NO: 347; or
k) the VH of SEQ ID NO: 348 and the VL of SEQ ID NO: 349.

In other embodiments, the first antigen binding domain that binds HLA-G is conjugated to a first immunoglobulin (Ig) constant region or a fragment of the first Ig constant region and/or the second antigen binding domain that binds the lymphocyte antigen is conjugated to a second immunoglobulin (Ig) constant region or a fragment of the second Ig constant region.

In other embodiments, the isolated multispecific protein further comprises a second linker (L2) between the first antigen binding domain that binds HLA-G and the first Ig constant region or the fragment of the first Ig constant region and the second antigen binding domain that binds the lymphocyte antigen and the second Ig constant region or the fragment of the second Ig constant region.

In other embodiments, the L2 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

In other embodiments, the first Ig constant region or the fragment of the first Ig constant region and the second Ig constant region or the fragment of the second Ig constant region is an IgG1, an IgG2, and IgG3 or an IgG4 isotype.

In other embodiments, the first Ig constant region or the fragment of the first Ig constant region and the second Ig constant region or the fragment of the second Ig constant region comprises at least one mutation that results in reduced binding of the multispecific protein to a FcγR.

In other embodiments, the at least one mutation that results in reduced binding of the multispecific protein to the FcγR is selected from the group consisting of L235A/D265S, F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

In other embodiments, the first Ig constant region or the fragment of the first Ig constant region and the second Ig constant region or the fragment of the second Ig constant region comprises at least one mutation that results in enhanced binding of the multispecific protein to a Fcγ receptor (FcγR).

In other embodiments, the at least one mutation that results in enhanced binding of the multispecific protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

In other embodiments, the FcγR is FcγRI, FcγRIIA, FcγRIIB or FcγRIII, or any combination thereof.

In other embodiments, the first Ig constant region or the fragment of the first Ig constant region and the second Ig constant region or the fragment of the second Ig constant region comprises at least one mutation that modulates a half-life of the multispecific protein.

In other embodiments, the at least one mutation that modulates the half-life of the multispecific protein is selected from the group consisting of H435A, P257I/N434H, D376V/N434H, M252Y/S254T/T256E/H433K/N434F, T308P/N434A and H435R, wherein residue numbering is according to the EU index.

In other embodiments, the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region.

In other embodiments, the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region is selected from the group consisting of T350V, L351Y, F405A, Y407V, T366Y, T366W, F405W, T394W, T394S, Y407T, Y407A, T366S/L368A/Y407V, L351Y/F405A/Y407V, T366I/K392M/T394W, F405A/Y407V, T366L/K392M/T394W, L351Y/Y407A, T366A/K409F, L351Y/Y407A, T366V/K409F, T366A/K409F, T350V/L351Y/F405A/Y407V and T350V/T366L/K392L/T394W, wherein residue numbering is according to the EU index.

In other embodiments, the first Ig constant region or the fragment of the first Ig constant region and the second Ig constant region or the fragment of the second Ig constant region comprise the following mutations:
a) L235A_L235A_D265S_T350V_L351Y_F405A_Y407V in the first Ig constant region and L235A_L235A_D265S_T350V_T366L_K392L_T394W in the second Ig constant region; or
b) L235A_L235A_D265S_T350V_T366L_K392L_T394W in the first Ig constant region and L235A_L235A_D265S_T350V_L351Y_F405A_Y407V in the second Ig constant region.

In certain embodiments, the disclosure provides an immunoconjugate comprising the isolated protein of the disclosure conjugated to a therapeutic agent or an imaging agent.

In certain embodiments, the disclosure provides a pharmaceutical composition comprising the isolated protein of the disclosure and a pharmaceutically acceptable carrier.

In certain embodiments, the disclosure provides a polynucleotide encoding the isolated protein of the disclosure.

In certain embodiments, the disclosure provides a vector comprising the polynucleotide encoding the isolated protein of the disclosure.

In certain embodiments, the disclosure provides a host cell comprising the vector encoding the isolated protein of the disclosure.

In certain embodiments, the disclosure provides a method of producing the isolated protein of the disclosure, comprising culturing the host cell of the disclosure in conditions that the protein is expressed, and recovering the protein produced by the host cell.

In certain embodiments, the disclosure provides an immunoconjugate comprising the isolated multispecific protein of the disclosure conjugated to a therapeutic agent or an imaging agent.

In certain embodiments, the disclosure provides a pharmaceutical composition comprising the isolated multispecific protein of the disclosure and a pharmaceutically acceptable carrier.

In certain embodiments, the disclosure provides a polynucleotide encoding the isolated multispecific protein of the disclosure.

In certain embodiments, the disclosure provides a vector comprising the polynucleotide encoding the isolated multispecific protein of the disclosure.

In certain embodiments, the disclosure provides a host cell comprising the vector comprising the polynucleotide encoding the isolated multispecific protein of the disclosure.

In certain embodiments, the disclosure provides a method of producing the isolated multispecific protein of the disclosure, comprising culturing the host cell in conditions that the multispecific protein is expressed, and recovering the multispecific protein produced by the host cell.

In certain embodiments, the disclosure provides a method of treating a HLA-G expressing cancer in a subject, comprising administering a therapeutically effective amount of the isolated protein of the disclosure, the isolated multispecific protein of the disclosure, the immunoconjugate of the disclosure, or the pharmaceutical composition of the disclosure to the subject for a time sufficient to treat the HLA-G expressing cancer.

In certain embodiments, the disclosure provides a method of reducing the amount of HLA-G expressing tumor cells in a subject, comprising administering the isolated protein of the disclosure, the isolated multispecific protein of the disclosure, the immunoconjugate of the disclosure, or the pharmaceutical composition of the disclosure to the subject for a time sufficient to reduce the amount of HLA-G expressing tumor cells.

In certain embodiments, the disclosure provides a method of preventing establishment of a HLA-G expressing cancer in a subject, comprising administering the isolated protein of the disclosure, the isolated multispecific protein of the disclosure, the immunoconjugate of the disclosure, or the pharmaceutical composition of the disclosure to the subject to prevent establishment of the HLA-G expressing cancer in the subject.

In certain embodiments, the disclosure provides a method of treating a non-cancerous condition in a subject at risk of developing a HLA-G expressing cancer, comprising administering the isolated protein of the disclosure, the isolated multispecific protein of the disclosure, the immunoconjugate of the disclosure, or the pharmaceutical composition of the disclosure to the subject to treat the noncancerous condition.

In other embodiments, the HLA-G expressing cancer is a lung cancer, a pancreatic cancer, a renal cancer, a head and neck cancer, an ovarian cancer, an esophageal cancer, or a breast cancer.

In other embodiments, the isolated protein or the isolated multispecific protein is administered in combination with a second therapeutic agent.

In other embodiments, the second therapeutic agent is surgery, chemotherapy, hormone receptor deprivation therapy or radiation, or any combination thereof.

In certain embodiments, the disclosure provides a method of detecting the presence of in a subject, comprising administering the immunoconjugate of the disclosure to a subject suspected to have cancer and visualizing the biological structures to which the immunoconjugate is bound, thereby detecting the presence of cancer.

In certain embodiments, the disclosure provides a kit comprising the isolated protein of the disclosure, the isolated multispecific protein of the disclosure, the immunoconjugate of the disclosure, or the pharmaceutical composition of the disclosure.

In certain embodiments, the disclosure provides aa anti-idiotypic antibody binding to the isolated protein of the disclosure.

In certain embodiments, the disclosure provides aa isolated protein comprising an antigen binding domain that binds to an epitope on HLA-G, wherein the epitope is a discontinuous epitope comprising the amino acid sequences of HHPVFDYE (SEQ ID NO: 485) and VPS.

In certain embodiments, the disclosure provides an isolated protein comprising an amino acid sequence of SEQ ID NOs: 478 or 479.

In certain embodiments, the disclosure provides an isolated protein comprising an amino acid sequence of SEQ ID NOs: 478.

In certain embodiments, the disclosure provides an isolated protein comprising an amino acid sequence of SEQ ID NOs: 479.

In certain embodiments, the isolated protein comprises amino acid sequences of SEQ ID NO: 490.

In certain embodiments, the isolated protein comprises amino acid sequences of SEQ ID NOs: 489 and 447. In certain embodiments, the isolated protein comprises an amino acid sequence of SEQ ID NO: 439.

In certain embodiments, the disclosure provides an isolated protein comprising amino acid sequences of SEQ ID NOs: 465 and 468.

In certain embodiments, the disclosure provides an isolated protein comprising amino acid sequences of SEQ ID NOs: 466 and 469.

In certain embodiments, the disclosure provides an isolated protein comprising amino acid sequences of SEQ ID NOs: 467 and 470.

BRIEF DESCRIPTION OF THE DRAWINGS

The foregoing will be apparent from the following more particular description of example embodiments, as illustrated in the accompanying drawings.

FIG. 3A shows NKL cell-mediated cytotoxicity; FIG. 3B shows NK-92 cell-mediated cytotoxicity.

FIG. 4A shows NKL cell-mediated cytotoxicity; FIG. 4B shows NK-92 cell-mediated cytotoxicity.

FIG. 5A shows NKL cell-mediated cytotoxicity; FIG. 5B shows NK-92 cell-mediated cytotoxicity.

FIG. 6A shows NKL cell-mediated cytotoxicity; FIG. 6B shows NK-92 cell-mediated cytotoxicity.

FIG. 7A shows NKL cell-mediated cytotoxicity; FIG. 7B shows NK-92 cell-mediated cytotoxicity.

FIG. 8A shows NKL cell-mediated cytotoxicity; FIG. 8B shows NK-92 cell-mediated cytotoxicity.

FIG. 13 shows the alignment of the VL regions of CD3B815 (SEQ ID NO: 340), CD3W244 (SEQ ID NO: 341), CD3W245 (SEQ ID NO: 342), CD3W246 (SEQ ID NO: 343), CD3W247 (SEQ ID NO: 344), and CD3W248 (SEQ ID NO: 345).

DETAILED DESCRIPTION

Figure 1:
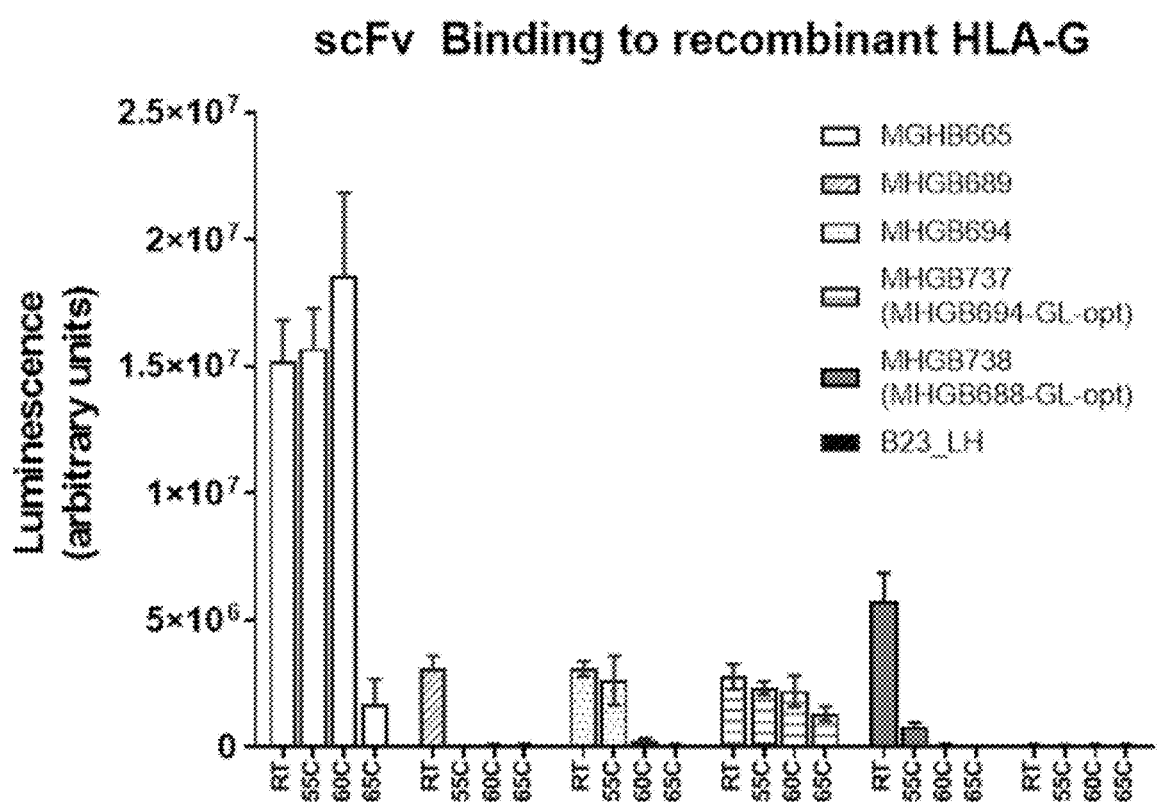
FIG. 1 shows the ability of v-regions to bind recombinant HLA-G after heat treatment when formatted as scFv.

The disclosed methods may be understood more readily by reference to the following detailed description taken in connection with the accompanying figures, which form a part of this disclosure. It is to be understood that the disclosed methods are not limited to the specific methods described and/or shown herein, and that the terminology used herein is for the purpose of describing particular embodiments by way of example only and is not intended to be limiting of the claimed methods.

All patents, published patent applications and publications cited herein are incorporated by reference as if set forth fully herein.

When a list is presented, unless stated otherwise, it is to be understood that each individual element of that list, and every combination of that list, is a separate embodiment. For example, a list of embodiments presented as "A, B, or C" is to be interpreted as including the embodiments, "A," "B," "C," "A or B," "A or C," "B or C," or "A, B, or C."

As used in this specification and the appended claims, the singular forms "a," "an," and "the" include plural referents unless the content clearly dictates otherwise. Thus, for example, reference to "a cell" includes a combination of two or more cells, and the like.

The transitional terms "comprising," "consisting essentially of," and "consisting of" are intended to connote their generally accepted meanings in the patent vernacular; that is, (i) "comprising," which is synonymous with "including," "containing," or "characterized by," is inclusive or open-ended and does not exclude additional, unrecited elements or method steps; (ii) "consisting of" excludes any element, step, or ingredient not specified in the claim; and (iii) "consisting essentially of" limits the scope of a claim to the specified materials or steps "and those that do not materially affect the basic and novel characteristic(s)" of the claimed invention. Embodiments described in terms of the phrase "comprising" (or its equivalents) also provide as embodiments those independently described in terms of "consisting of" and "consisting essentially of."

"About" means within an acceptable error range for the particular value as determined by one of ordinary skill in the art, which will depend in part on how the value is measured or determined, i.e., the limitations of the measurement system. Unless explicitly stated otherwise within the Examples or elsewhere in the Specification in the context of a particular assay, result or embodiment, "about" means within one standard deviation per the practice in the art, or a range of up to 5%, whichever is larger.

"Activation" or "stimulation" or "activated" or "stimulated" refers to induction of a change in the biologic state of a cell resulting in expression of activation markers, cytokine production, proliferation or mediating cytotoxicity of target cells. Cells may be activated by primary stimulatory signals. Co-stimulatory signals can amplify the magnitude of the primary signals and suppress cell death following initial stimulation resulting in a more durable activation state and thus a higher cytotoxic capacity. A "co-stimulatory signal" refers to a signal, which in combination with a primary signal, such as TCR/CD3 ligation, leads to T cell and/or NK cell proliferation and/or upregulation or downregulation of key molecules.

"Alternative scaffold" refers to a single chain protein framework that contains a structured core associated with variable domains of high conformational tolerance. The variable domains tolerate variation to be introduced without compromising scaffold integrity, and hence the variable domains can be engineered and selected for binding to a specific antigen.

"Antibody-dependent cellular cytotoxicity", "antibody-dependent cell-mediated cytotoxicity" or "ADCC" refers to the mechanism of inducing cell death that depends upon the interaction of antibody-coated target cells with effector cells possessing lytic activity, such as natural killer cells (NK), monocytes, macrophages and neutrophils via Fc gamma receptors (FcγR) expressed on effector cells.

"Antibody-dependent cellular phagocytosis" or "ADCP" refers to the mechanism of elimination of antibody-coated target cells by internalization by phagocytic cells, such as macrophages or dendritic cells.

"Antigen" refers to any molecule (e.g., protein, peptide, polysaccharide, glycoprotein, glycolipid, nucleic acid, portions thereof, or combinations thereof) capable of being bound by an antigen binding domain or a T-cell receptor that is capable of mediating an immune response. Exemplary immune responses include antibody production and activation of immune cells, such as T cells, B cells or NK cells. Antigens may be expressed by genes, synthesized, or purified from biological samples such as a tissue sample, a tumor sample, a cell or a fluid with other biological components, organisms, subunits of proteins/antigens, killed or inactivated whole cells or lysates.

"Antigen binding fragment" or "antigen binding domain" refers to a portion of the protein that binds an antigen. Antigen binding fragments may be synthetic, enzymatically obtainable or genetically engineered polypeptides and include portions of an immunoglobulin that bind an antigen, such as VH, the VL, the VH and the VL, Fab, Fab', F(ab')$_2$, Fd and Fv fragments, domain antibodies (dAb) consisting of one VH domain or one VL domain, shark variable IgNAR domains, camelized VH domains, VHH domains, minimal recognition units consisting of the amino acid residues that mimic the CDRs of an antibody, such as FR3-CDR3-FR4 portions, the HCDR1, the HCDR2 and/or the HCDR3 and the LCDR1, the LCDR2 and/or the LCDR3, alternative scaffolds that bind an antigen, and multispecific proteins comprising the antigen binding fragments. Antigen binding fragments (such as VH and VL) may be linked together via a synthetic linker to form various types of single antibody designs where the VH/VL domains may pair intramolecularly, or intermolecularly in those cases when the VH and VL domains are expressed by separate single chains, to form a monovalent antigen binding domain, such as single chain Fv (scFv) or diabody. Antigen binding fragments may also be conjugated to other antibodies, proteins, antigen binding fragments or alternative scaffolds which may be monospecific or multispecific to engineer bispecific and multispecific proteins.

"Antibodies" is meant in a broad sense and includes immunoglobulin molecules including monoclonal antibodies including murine, human, humanized and chimeric monoclonal antibodies, antigen binding fragments, multispecific antibodies, such as bispecific, trispecific, tetraspecific etc., dimeric, tetrameric or multimeric antibodies, single chain antibodies, domain antibodies and any other modified configuration of the immunoglobulin molecule that comprises an antigen binding site of the required specificity. "Full length antibodies" are comprised of two heavy chains (HC) and two light chains (LC) inter-connected by disulfide bonds as well as multimers thereof (e.g. IgM). Each heavy chain is comprised of a heavy chain variable region (VH) and a heavy chain constant region (comprised of domains CH1, hinge, CH2 and CH3). Each light chain is comprised of a light chain variable region (VL) and a light chain constant region (CL). The VH and the VL regions may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4. Immunoglobulins may be assigned to five major classes, IgA, IgD, IgE, IgG and IgM, depending on the heavy chain constant domain amino acid sequence. IgA and IgG are further sub-classified as the isotypes IgA1, IgA2, IgG1, IgG2, IgG3 and IgG4. Antibody light chains of any vertebrate species may be assigned to one of two clearly distinct types, namely kappa (κ) and lambda (λ), based on the amino acid sequences of their constant domains.

"Bispecific" refers to a molecule (such as an antibody) that specifically binds two distinct antigens or two distinct epitopes within the same antigen. The bispecific molecule may have cross-reactivity to other related antigens, for example to the same antigen from other species (homologs), such as human or monkey, for example *Macaca cynomolgus* (*cynomolgus*, cyno) or Pan troglodytes, or may bind an epitope that is shared between two or more distinct antigens.

"Cancer" refers to a broad group of various diseases characterized by the uncontrolled growth of abnormal cells in the body. Unregulated cell division and growth results in the formation of malignant tumors that invade neighboring tissues and may also metastasize to distant parts of the body through the lymphatic system or bloodstream. A "cancer" or "cancer tissue" can include a tumor.

"Complement-dependent cytotoxicity" or "CDC", refers to the mechanism of inducing cell death in which the Fc effector domain of a target-bound protein binds and activates complement component C1q which in turn activates the complement cascade leading to target cell death. Activation of complement may also result in deposition of complement components on the target cell surface that facilitate CDC by binding complement receptors (e.g., CR3) on leukocytes "Complementarity determining regions" (CDR) are antibody regions that bind an antigen. There are three CDRs in the VH (HCDR1, HCDR2, HCDR3) and three CDRs in the VL (LCDR1, LCDR2, LCDR3). CDRs may be defined using various delineations such as Kabat (Wu et al. (1970) J Exp Med 132: 211-50; Kabat et al., Sequences of Proteins of Immunological Interest, 5th Ed. Public Health Service, National Institutes of Health, Bethesda, Md., 1991), Chothia (Chothia et al. (1987) J Mol Biol 196: 901-17), IMGT (Lefranc et al. (2003) Dev Comp Immunol 27: 55-77) and AbM (Martin and Thornton J Bmol Biol 263: 800-15, 1996). The correspondence between the various delineations and variable region numbering is described (see e.g. Lefranc et al. (2003) Dev Comp Immunol 27: 55-77; Honegger and Pluckthun, J Mol Biol (2001) 309:657-70; International ImMunoGeneTics (IMGT) database; Web resources, http://www_imgt_org). Available programs such as abYsis by UCL Business PLC may be used to delineate CDRs. The term "CDR", "HCDR1", "HCDR2", "HCDR3", "LCDR1", "LCDR2" and "LCDR3" as used herein includes CDRs defined by any of the methods described supra, Kabat, Chothia, IMGT or AbM, unless otherwise explicitly stated in the specification.

"Decrease," "lower," "lessen," "reduce," or "abate" refers generally to the ability of a test molecule to mediate a reduced response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP. Decrease may be a statistically significant difference in the measured response between the test molecule and the control (or the vehicle), or a decrease in the measured response, such as a decrease of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7. 1.8, etc.).

"Differentiation" refers to a method of decreasing the potency or proliferation of a cell or moving the cell to a more developmentally restricted state.

"Encode" or "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence, and the noncoding strand, used as the template for transcription of a gene or cDNA, can be referred to as encoding the protein or other product of that gene or cDNA.

"Enhance," "promote," "increase," "expand" or "improve" refers generally to the ability of a test molecule to mediate a greater response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP Enhance may be a statistically significant difference in the measured response between the test molecule and control (or vehicle), or an increase in the measured response, such as an increase of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7. 1.8, etc.).

"Expansion" refers to the outcome of cell division and cell death.

"Express" and "expression" refers the to the well-known transcription and translation occurring in cells or in vitro. The expression product, e.g., the protein, is thus expressed by the cell or in vitro and may be an intracellular, extracellular or a transmembrane protein.

"Expression vector" refers to a vector that can be utilized in a biological system or in a reconstituted biological system to direct the translation of a polypeptide encoded by a polynucleotide sequence present in the expression vector.

"dAb" or "dAb fragment" refers to an antibody fragment composed of a VH domain (Ward et al., Nature 341:544546 (1989)).

"Fab" or "Fab fragment" refers to an antibody fragment composed of VH, CH1, VL and CL domains.

"F(ab')2" or "F(ab')2 fragment" refers to an antibody fragment containing two Fab fragments connected by a disulfide bridge in the hinge region.

"Fd" or "Fd fragment" refers to an antibody fragment composed of VH and CH1 domains.

"Fv" or "Fv fragment" refers to an antibody fragment composed of the VH and the VL domains from a single arm of the antibody.

"Full length antibody" is comprised of two heavy chains (HC) and two light chains (LC) inter-connected by disulfide bonds as well as multimers thereof (e.g. IgM). Each heavy chain is comprised of a heavy chain variable domain (VH) and a heavy chain constant domain, the heavy chain constant domain comprised of subdomains CH1, hinge, CH2 and CH3. Each light chain is comprised of a light chain variable domain (VL) and a light chain constant domain (CL). The VH and the VL may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4.

"Genetic modification" refers to the introduction of a "foreign" (i.e., extrinsic or extracellular) gene, DNA or RNA sequence to a host cell, so that the host cell will express the introduced gene or sequence to produce a desired substance, typically a protein or enzyme coded by the introduced gene or sequence. The introduced gene or sequence may also be called a "cloned" or "foreign" gene or sequence, may include regulatory or control sequences operably linked to polynucleotide encoding the chimeric antigen receptor, such as start, stop, promoter, signal, secretion, or other sequences used by a cell's genetic machinery. The gene or sequence may include nonfunctional sequences or sequences with no known function. A host cell that receives and expresses introduced DNA or RNA has been "genetically engineered." The DNA or RNA introduced to a host cell can come from any source, including cells of the same genus or species as the host cell, or from a different genus or species.

"Heterologous" refers to two or more polynucleotides or two or more polypeptides that are not found in the same relationship to each other in nature.

"Heterologous polynucleotide" refers to a non-naturally occurring polynucleotide that encodes two or more neoantigens as described herein.

"Heterologous polypeptide" refers to a non-naturally occurring polypeptide comprising two or more neoantigen polypeptides as described herein.

"Host cell" refers to any cell that contains a heterologous nucleic acid. An exemplary heterologous nucleic acid is a vector (e.g., an expression vector).

"Human antibody" refers to an antibody that is optimized to have minimal immune response when administered to a human subject. Variable regions of human antibody are derived from human immunoglobulin sequences. If human antibody contains a constant region or a portion of the constant region, the constant region is also derived from human immunoglobulin sequences. Human antibody comprises heavy and light chain variable regions that are "derived from" sequences of human origin if the variable regions of the human antibody are obtained from a system that uses human germline immunoglobulin or rearranged immunoglobulin genes. Such exemplary systems are human immunoglobulin gene libraries displayed on phage, and transgenic non-human animals such as mice or rats carrying human immunoglobulin loci. "Human antibody" typically contains amino acid differences when compared to the immunoglobulins expressed in humans due to differences between the systems used to obtain the human antibody and human immunoglobulin loci, introduction of somatic mutations or intentional introduction of substitutions into the frameworks or CDRs, or both. Typically, "human antibody" is at least about 80%, 81%, 82%, 83%, 84%, 85%, 86%, 87%, 88%, 89%, 90%, 91%, 92%, 93%, 94%, 95%, 96%, 97%, 98% or 99% identical in amino acid sequence to an amino acid sequence encoded by human germline immunoglobulin or rearranged immunoglobulin genes. In some cases, "human antibody" may contain consensus framework sequences derived from human framework sequence analyses, for example as described in Knappik et al., (2000) J Mol Biol 296:57-86, or a synthetic HCDR3 incorporated into human immunoglobulin gene libraries displayed on phage, for example as described in Shi et al., (2010) J Mol Biol 397:385-96, and in Int. Patent Publ. No. WO2009/085462. Antibodies in which at least one CDR is derived from a non-human species are not included in the definition of "human antibody".

"Humanized antibody" refers to an antibody in which at least one CDR is derived from non-human species and at least one framework is derived from human immunoglobulin sequences. Humanized antibody may include substitutions in the frameworks so that the frameworks may not be exact copies of expressed human immunoglobulin or human immunoglobulin germline gene sequences.

"In combination with" means that two or more therapeutic agents are be administered to a subject together in a mixture, concurrently as single agents or sequentially as single agents in any order.

"Isolated" refers to a homogenous population of molecules (such as synthetic polynucleotides or polypeptides) which have been substantially separated and/or purified away from other components of the system the molecules are produced in, such as a recombinant cell, as well as a protein that has been subjected to at least one purification or isolation step. "Isolated" refers to a molecule that is substantially free of other cellular material and/or chemicals and encompasses molecules that are isolated to a higher purity, such as to 80%, 81%, 82%, 83%, 84%, 85%, 86%, 87%, 88%, 89%, 90%, 91%, 92%, 93%, 94%, 95%, 96%, 97%, 98%, 99% or 100% purity.

"Human leukocyte antigen G" or "HLA-G" refers to a known protein which is also called "HLA class I histocompatibility antigen, alpha chain G" or "MHC class I antigen G". All HLA-G isoforms and variants are encompassed in "HLA-G". The amino acid sequences of the various isoforms are retrievable from Uniprot ID numbers P17693-1 through P17693-7 and are shown in Table 1.

TABLE 1

Sequences of HLA-G isoforms

| Isoform | Uniprot ID | Protein Sequence |
|---|---|---|
| HLA-G1 | P17693-1 | SEQ ID NO: 1<br>MVVMAPRTLFLLLSGALTLTETWAGSHSMRYFSAAVSRPGRGEPRFIAMGY<br>VDDTQFVRFDSDSACPRMEPRAPWVEQEGPEYWEEETRNTKAHAQTDRMNL<br>QTLRGYYNQSEASSHTLQWMIGCDLGSDGRLLRGYEQYAYDGKDYLALNED<br>LRSWTAADTAAQISKRKCEAANVAEQRRAYLEGTCVEWLHRYLENGKEMLQ<br>RADPPKTHVTHHPVFDYEATLRCWALGFYPAEIILTWQRDGEDQTQDVELV<br>ETRPAGDGTFQKWAAVVVPSGEEQRYTCHVQHEGLPEPLMLRWKQSSLPT<br>IPIMGIVAGLVVLAAVVTGAAVAAVLWRKKSSD |
| HLA-G2 | P17693-2 | SEQ ID NO: 2<br>MVVMAPRTLFLLLSGALTLTETWAGSHSMRYFSAAVSRPGRGEPRFIAMGY<br>VDDTQFVRFDSDSACPRMEPRAPWVEQEGPEYWEEETRNTKAHAQTDRMNL<br>QTLRGYYNQSEAKPPKTHVTHHPVFDYEATLRCWALGFYPAEIILTWQRDG<br>EDQTQDVELVETRPAGDGTFQKWAAVVVPSGEEQRYTCHVQHEGLPEPLML<br>RWKQSSLPTIPIMGIVAGLVVLAAVVTGAAVAAVLWRKKSSD |
| HLA-G3 | P17693-3 | SEQ ID NO: 3<br>MVVMAPRTLFLLLSGALTLTETWAGSHSMRYFSAAVSRPGRGEPRFIAMGY<br>VDDTQFVRFDSDSACPRMEPRAPWVEQEGPEYWEEETRNTKAHAQTDRMNL<br>QTLRGYYNQSEAKQSSLPTIPIMGIVAGLVVLAAVVTGAAVAAVLWRKKSS<br>D |
| HLA-G4 | P17693-4 | SEQ ID NO: 4<br>MVVMAPRTLFLLLSGALTLTETWAGSHSMRYFSAAVSRPGRGEPRFIAMGY<br>VDDTQFVRFDSDSACPRMEPRAPWVEQEGPEYWEEETRNTKAHAQTDRMNL<br>QTLRGYYNQSEASSHTLQWMIGCDLGSDGRLLRGYEQYAYDGKDYLALNED<br>LRSWTAADTAAQISKRKCEAANVAEQRRAYLEGTCVEWLHRYLENGKEMLQ<br>RAKQSSLPTIPIMGIVAGLVVLAAVVTGAAVAAVLWRKKSSD |
| HLA-G5 | P17693-5 | SEQ ID NO: 5<br>MVVMAPRTLFLLLSGALTLTETWAGSHSMRYFSAAVSRPGRGEPRFIAMGY<br>VDDTQFVRFDSDSACPRMEPRAPWVEQEGPEYWEEETRNTKAHAQTDRMNL<br>QTLRGYYNQSEASSHTLQWMIGCDLGSDGRLLRGYEQYAYDGKDYLALNED |

TABLE 1-continued

Sequences of HLA-G isoforms

| Isoform | Uniprot ID | Protein Sequence |
|---|---|---|
| | | LRSWTAADTAAQISKRKCEAANVAEQRRAYLEGTCVEWLHRYLENGKEMLQ |
| | | RA<u><u>DPPKTHVTHHPVFDYEATLRCWALGFYPAEIILTWQRDGEDQTQDVELV</u></u> |
| | | <u><u>ETRPAGDGTFQKWAAVVVPSGEEQRYTCHVQHEGLPEPLMLRWS</u></u>KEGDGGI |
| | | MSVRESRSLSEDL |
| HLA-G6 | P17693-6 | SEQ ID NO: 6 |
| | | *MVVMAPRTLFLLLSGALTLTETWA*GSHSMRYFSAAVSRPGRGEPRFIAMGY |
| | | VDDTQFVRFDSDSACPRMEPRAPWVEQEGPEYWEEETRNTKAHAQTDRMNL |
| | | QTLRGYYNQSEAK<u>PPKTHVTHHPVFDYEATLRCWALGFYPAEIILTWQRDG</u> |
| | | <u>EDQTQDVELV</u>ETRPAGDGTFQKWAAVVVPSGEEQRYTCHVQHEGLPEPLML |
| | | RWSKEGDGGIMSVRESRSLSEDL |
| HLA-G7 | P17693-7 | SEQ ID NO: 7 |
| | | *MVVMAPRTLFLLLSGALTLTETWA*GSHSMRYFSAAVSRPGRGEPRFIAMGY |
| | | VDDTQFVRFDSDSACPRMEPRAPWVEQEGPEYWEEETRNTKAHAQTDRMNL |
| | | QTLRGYYNQSEASE |

Signal sequence: italic; α1 domain: underlined; α2 domain: bold; α3 domain: double underlined; transmembrane region: dashed underline.

"Modulate" refers to either enhanced or decreased ability of a test molecule to mediate an enhanced or a reduced response (i.e., downstream effect) when compared to the response mediated by a control or a vehicle.

"Monoclonal antibody" refers to an antibody obtained from a substantially homogenous population of antibody molecules, i.e., the individual antibodies comprising the population are identical except for possible well-known alterations such as removal of C-terminal lysine from the antibody heavy chain or post-translational modifications such as amino acid isomerization or deamidation, methionine oxidation or asparagine or glutamine deamidation. Monoclonal antibodies typically bind one antigenic epitope. A bispecific monoclonal antibody binds two distinct antigenic epitopes. Monoclonal antibodies may have heterogeneous glycosylation within the antibody population. Monoclonal antibody may be monospecific or multispecific such as bispecific, monovalent, bivalent or multivalent.

"Multispecific" refers to a molecule, such as an antibody that specifically binds two or more distinct antigens or two or more distinct epitopes within the same antigen. Multispecific molecule may have cross-reactivity to other related antigens, for example to the same antigen from other species (homologs), such as human or monkey, for example *Macaca fascicularis* (*cynomolgus*, cyno) or Pan troglodytes, or may bind an epitope that is shared between two or more distinct antigens.

"Natural killer cell" and "NK cell" are used interchangeably and synonymously herein. NK cell refers to a differentiated lymphocyte with a $CD16^+$ $CD56^+$ and/or $CD57^+$ $TCR^-$ phenotype. NK cells are characterized by their ability to bind to and kill cells that fail to express "self" MHC/HLA antigens by the activation of specific cytolytic enzymes, the ability to kill tumor cells or other diseased cells that express a ligand for NK activating receptors, and the ability to release protein molecules called cytokines that stimulate or inhibit the immune response.

"Operatively linked" and similar phrases, when used in reference to nucleic acids or amino acids, refers to the operational linkage of nucleic acid sequences or amino acid sequence, respectively, placed in functional relationships with each other. For example, an operatively linked promoter, enhancer elements, open reading frame, 5' and 3' UTR, and terminator sequences result in the accurate production of a nucleic acid molecule (e.g., RNA) and in some instances to the production of a polypeptide (i.e., expression of the open reading frame). Operatively linked peptide refers to a peptide in which the functional domains of the peptide are placed with appropriate distance from each other to impart the intended function of each domain.

"Pharmaceutical combination" refers to a combination of two or more active ingredients administered either together or separately.

"Pharmaceutical composition" refers to a composition that results from combining an active ingredient and a pharmaceutically acceptable carrier.

"Pharmaceutically acceptable carrier" or "excipient" refers to an ingredient in a pharmaceutical composition, other than the active ingredient, which is nontoxic to a subject. Exemplary pharmaceutically acceptable carriers are a buffer, stabilizer or preservative.

"Polynucleotide" or "nucleic acid" refers to a synthetic molecule comprising a chain of nucleotides covalently linked by a sugar-phosphate backbone or other equivalent covalent chemistry. cDNA is a typical example of a polynucleotide. Polynucleotide may be a DNA or a RNA molecule.

"Prevent," "preventing," "prevention," or "prophylaxis" of a disease or disorder means preventing that a disorder occurs in a subject.

"Proliferation" refers to an increase in cell division, either symmetric or asymmetric division of cells.

"Promoter" refers to the minimal sequences required to initiate transcription. Promoter may also include enhancers or repressor elements which enhance or suppress transcription, respectively.

"Protein" or "polypeptide" are used interchangeably herein are refers to a molecule that comprises one or more polypeptides each comprised of at least two amino acid residues linked by a peptide bond. Protein may be a monomer, or may be protein complex of two or more subunits, the subunits being identical or distinct. Small polypeptides of less than 50 amino acids may be referred to as "peptides". Protein may be a heterologous fusion protein, a glycoprotein, or a protein modified by post-translational modifications such as phosphorylation, acetylation, myristoylation, palmitoylation, glycosylation, oxidation, formylation, amidation, citrullination, polyglutamylation, ADP-ribosylation, pegylation or biotinylation. Protein may be recombinantly expressed.

"Recombinant" refers to polynucleotides, polypeptides, vectors, viruses and other macromolecules that are prepared, expressed, created or isolated by recombinant means.

"Regulatory element" refers to any cis- or trans acting genetic element that controls some aspect of the expression of nucleic acid sequences.

"Relapsed" refers to the return of a disease or the signs and symptoms of a disease after a period of improvement after prior treatment with a therapeutic.

"Refractory" refers to a disease that does not respond to a treatment. A refractory disease can be resistant to a treatment before or at the beginning of the treatment, or a refractory disease can become resistant during a treatment.

"Single chain Fv" or "scFv" refers to a fusion protein comprising at least one antibody fragment comprising a light chain variable region (VL) and at least one antibody fragment comprising a heavy chain variable region (VH), wherein the VL and the VH are contiguously linked via a polypeptide linker, and capable of being expressed as a single chain polypeptide. Unless specified, as used herein, a scFv may have the VL and VH variable regions in either order, e.g., with respect to the N-terminal and C-terminal ends of the polypeptide, the scFv may comprise VL-linker-VH or may comprise VH-linker-VL.

"Specifically binds," "specific binding," "specifically binding" or "binds" refer to a proteinaceous molecule binding to an antigen or an epitope within the antigen with greater affinity than for other antigens. Typically, the proteinaceous molecule binds to the antigen or the epitope within the antigen with an equilibrium dissociation constant ($K_D$) of about $1\times10^{-7}$ M or less, for example about $5\times10^{-8}$ M or less, about $1\times10^{-8}$ M or less, about $1\times10^{-9}$ M or less, about $1\times10^{-10}$ M or less, about $1\times10^{-11}$ M or less, or about $1\times10^{12}$ M or less, typically with the $K_D$ that is at least one hundred fold less than its $K_D$ for binding to a non-specific antigen (e.g., BSA, casein). In the context of the prostate neoantigens described here, "specific binding" refers to binding of the proteinaceous molecule to the prostate neoantigen without detectable binding to a wild-type protein the neoantigen is a variant of.

"Subject" includes any human or nonhuman animal. "Nonhuman animal" includes all vertebrates, e.g., mammals and non-mammals, such as nonhuman primates, sheep, dogs, cats, horses, cows, chickens, amphibians, reptiles, etc. The terms "subject" and "patient" can be used interchangeably herein.

"T cell" and "T lymphocyte" are interchangeable and used synonymously herein. T cell includes thymocytes, naïve T lymphocytes, memory T cells, immature T lymphocytes, mature T lymphocytes, resting T lymphocytes, or activated T lymphocytes. A T cell can be a T helper (Th) cell, for example a T helper 1 (Th1) or a T helper 2 (Th2) cell. The T cell can be a helper T cell (HTL; $CD4^+$ T cell) $CD4^+$ T cell, a cytotoxic T cell (CTL; $CD8^+$ T cell), a tumor infiltrating cytotoxic T cell (TIL; $CD8^+$ T cell), $CD4^+CD8^+$ T cell, or any other subset of T cells. Also included are "NKT cells", which refer to a specialized population of T cells that express a semi-invariant αβ T-cell receptor, but also express a variety of molecular markers that are typically associated with NK cells, such as NK1.1. NKT cells include $NK1.1^+$ and $NK1.1^-$, as well as $CD4^+$, $CD4^-$, $CD8^+$ and $CD8^-$ cells. The TCR on NKT cells is unique in that it recognizes glycolipid antigens presented by the MHC I-like molecule CD Id. NKT cells can have either protective or deleterious effects due to their abilities to produce cytokines that promote either inflammation or immune tolerance. Also included are "gamma-delta T cells (γδ T cells)," which refer to a specialized population that to a small subset of T cells possessing a distinct TCR on their surface, and unlike the majority of T cells in which the TCR is composed of two glycoprotein chains designated α- and β-TCR chains, the TCR in γδ T cells is made up of a γ-chain and a δ-chain. γδ T cells can play a role in immunosurveillance and immunoregulation, and were found to be an important source of IL-17 and to induce robust $CD8^+$ cytotoxic T cell response. Also included are "regulatory T cells" or "Tregs" which refer to T cells that suppress an abnormal or excessive immune response and play a role in immune tolerance. Tregs are typically transcription factor Foxp3-positive $CD4^+$T cells and can also include transcription factor Foxp3-negative regulatory T cells that are IL-10-producing $CD4^+$T cells.

"Therapeutically effective amount" or "effective amount" used interchangeably herein, refers to an amount effective, at dosages and for periods of time necessary, to achieve a desired therapeutic result. A therapeutically effective amount may vary according to factors such as the disease state, age, sex, and weight of the individual, and the ability of a therapeutic or a combination of therapeutics to elicit a desired response in the individual. Example indicators of an effective therapeutic or combination of therapeutics that include, for example, improved wellbeing of the patient, reduction of a tumor burden, arrested or slowed growth of a tumor, and/or absence of metastasis of cancer cells to other locations in the body.

"Transduction" refers to the introduction of a foreign nucleic acid into a cell using a viral vector.

"Treat," "treating" or "treatment" of a disease or disorder such as cancer refers to accomplishing one or more of the following: reducing the severity and/or duration of the disorder, inhibiting worsening of symptoms characteristic of the disorder being treated, limiting or preventing recurrence of the disorder in subjects that have previously had the disorder, or limiting or preventing recurrence of symptoms in subjects that were previously symptomatic for the disorder.

"Tumor cell" or a "cancer cell" refers to a cancerous, pre-cancerous or transformed cell, either in vivo, ex vivo, or in tissue culture, that has spontaneous or induced phenotypic changes. These changes do not necessarily involve the uptake of new genetic material. Although transformation may arise from infection with a transforming virus and incorporation of new genomic nucleic acid, uptake of exogenous nucleic acid or it can also arise spontaneously or following exposure to a carcinogen, thereby mutating an endogenous gene. Transformation/cancer is exemplified by morphological changes, immortalization of cells, aberrant growth control, foci formation, proliferation, malignancy, modulation of tumor specific marker levels, invasiveness, tumor growth in suitable animal hosts such as nude mice, and the like, in vitro, in vivo, and ex vivo.

"Variant," "mutant" or "altered" refers to a polypeptide or a polynucleotide that differs from a reference polypeptide or a reference polynucleotide by one or more modifications, for example one or more substitutions, insertions or deletions.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, MD. (1991), unless otherwise explicitly stated.

Mutations in the Ig constant regions are referred to as follows: L351Y_F405A_Y407V refers to L351Y, F405A and Y407V mutations in one immunoglobulin constant region. L351Y_F405A_Y407V/T394W refers to L351Y, F405A and Y407V mutations in the first Ig constant region and T394W mutation in the second Ig constant region, which are present in one multimeric protein.

Antigen Binding Domains that Bind HLA-G

The disclosure provides antigen binding domains that bind HLA-G, monospecific and multispecific proteins comprising the antigen binding domains that bind HLA-G, polynucleotides encoding the foregoing, vectors, host cells and methods of making and using the foregoing. The antigen binding domains that bind HLA-G identified herein demonstrated several unique properties such as 1) improved thermostability, 2) improved developability achieved by reducing the deamidation risk, 3) decreased immunogenicity, 4) specificity to HLA-G accompanied by the lack of cross-reactivity with HLA-A, HLA-B, HLA-C, and HLA-E, and 5) ability to overcome immune checkpoint ligand expression on tumor cells, and ensure tumor cell killing via T cell mediated cytotoxicity.

The disclosure provides an isolated protein comprising an antigen binding domain that binds human leukocyte antigen G (HLA-G), wherein the antigen binding domain that binds HLA-G comprises a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or the HCDR1, the HCDR2 and the HCDR3 of the VH of SEQ ID NO: 52 and the LCDR1, the LCDR2 and the LCDR3 of the VL of SEQ ID NO: 53; or the HCDR1, the HCDR2 and the HCDR3 of the VH of SEQ ID NO: 54 and the LCDR1, the LCDR2 and the LCDR3 of the VL of SEQ ID NO: 55; or the HCDR1, the HCDR2 and the HCDR3 of the VH of SEQ ID NO: 56 and the LCDR1, the LCDR2 and the LCDR3 of the VL of SEQ ID NO: 57; or the HCDR1, the HCDR2 and the HCDR3 of the VH of SEQ ID NO: 58 and the LCDR1, the LCDR2 and the LCDR3 of the VL of SEQ ID NO: 59; or the HCDR1, the HCDR2 and the HCDR3 of the VH of SEQ ID NO: 60 and the LCDR1, the LCDR2 and the LCDR3 of the VL of SEQ ID NO: 61; or the HCDR1, the HCDR2 and the HCDR3 of the VH of SEQ ID NO: 62 and the LCDR1, the LCDR2 and the LCDR3 of the VL of SEQ ID NO: 63; or the HCDR1, the HCDR2 and the HCDR3 of the VH of SEQ ID NO: 64 and the LCDR1, the LCDR2 and the LCDR3 of the VL of SEQ ID NO: 65; or the HCDR1, the HCDR2 and the HCDR3 of the VH of SEQ ID NO: 66 and the LCDR1, the LCDR2 and the LCDR3 of the VL of SEQ ID NO: 67; or the HCDR1, the HCDR2 and the HCDR3 of the VH of SEQ ID NO: 68 and the LCDR1, the LCDR2 and the LCDR3 of the VL of SEQ ID NO: 69.

The disclosure provides an isolated protein comprising an antigen binding domain that binds HLA-G, wherein the antigen binding domain that binds HLA-G comprises the HCDR1, the HCDR1, the HCDR3, the LCDR1, the LCDR2 and the LCDR3 of SEQ ID NOs: 70, 71, 72, 88, 89, and 90, respectively;
SEQ ID NOs: 73, 71, 74, 91, 89, and 92, respectively;
SEQ ID NOs: 75, 76, 77, 93, 89, and 94, respectively;
SEQ ID NOs: 78, 79, 80, 95, 89, and 96, respectively;
SEQ ID NOs: 81, 82, 83, 97, 89, and 98, respectively;
SEQ ID NOs: 78, 71, 84, 99, 89, and 100, respectively;
SEQ ID NOs: 78, 71, 84, 101, 89, and 100, respectively;
SEQ ID NOs: 85, 86, 87, 102, 103, and 104, respectively; or
SEQ ID NOs: 78, 71, 84, 95, 89, and 96, respectively.

The disclosure provides an isolated protein comprising an antigen binding domain that binds HLA-G, wherein the antigen binding domain that binds HLA-G comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

The disclosure provides an isolated protein comprising an antigen binding domain that binds HLA-G, wherein the antigen binding domain that binds HLA-G comprises the VH of SEQ ID NO: 50 and the VL of SEQ ID NO: 51;
the VH of SEQ ID NO: 52 and the VL of SEQ ID NO: 53;
the VH of SEQ ID NO: 54 and the VL of SEQ ID NO: 55;
the VH of SEQ ID NO: 56 and the VL of SEQ ID NO: 57;
the VH of SEQ ID NO: 58 and the VL of SEQ ID NO: 59;
the VH of SEQ ID NO: 60 and the VL of SEQ ID NO: 61;
the VH of SEQ ID NO: 62 and the VL of SEQ ID NO: 63;
the VH of SEQ ID NO: 64 and the VL of SEQ ID NO: 65;
the VH of SEQ ID NO: 66 and the VL of SEQ ID NO: 67; or
the VH of SEQ ID NO: 68 and the VL of SEQ ID NO: 69.

The disclosure provides an isolated protein comprising an antigen binding domain that binds HLA-G, wherein the antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

The disclosure also provides an isolated protein comprising an antigen binding domain that binds human leukocyte antigen G (HLA-G), wherein the antigen binding domain that binds HLA-G comprises a mutation engineered to provide germline optimization, the mutation is selected from the group consisting of E1Q, L5Q, E6Q, S71P, D46E and H77N mutations in the VH domain, and K30E and G66V in the VL domain. The disclosure also provides an isolated protein comprising an antigen binding domain that binds HLA-G, wherein the antigen binding domain that binds HLA-G comprises a mutation engineered to reduce the risk of post-translational modification, wherein the mutation is N92H in the VL domain.

The disclosure also provides an isolated protein comprising an antigen binding domain that binds HLA-G, wherein the antigen binding domain that binds HLA-G comprises the VH of SEQ ID NO: 50 and the VL of SEQ ID NO: 51;
the VH of SEQ ID NO: 50 and the VL of SEQ ID NO: 53;
the VH of SEQ ID NO: 50 and the VL of SEQ ID NO: 55;
the VH of SEQ ID NO: 50 and the VL of SEQ ID NO: 57;

the VH of SEQ ID NO: 50 and the VL of SEQ ID NO: 59;
the VH of SEQ ID NO: 50 and the VL of SEQ ID NO: 61;
the VH of SEQ ID NO: 50 and the VL of SEQ ID NO: 63;
the VH of SEQ ID NO: 50 and the VL of SEQ ID NO: 65;
the VH of SEQ ID NO: 50 and the VL of SEQ ID NO: 67;
the VH of SEQ ID NO: 50 and the VL of SEQ ID NO: 69;
the VH of SEQ ID NO: 52 and the VL of SEQ ID NO: 51;
the VH of SEQ ID NO: 52 and the VL of SEQ ID NO: 53;
the VH of SEQ ID NO: 52 and the VL of SEQ ID NO: 55;
the VH of SEQ ID NO: 52 and the VL of SEQ ID NO: 57;
the VH of SEQ ID NO: 52 and the VL of SEQ ID NO: 59;
the VH of SEQ ID NO: 52 and the VL of SEQ ID NO: 61;
the VH of SEQ ID NO: 52 and the VL of SEQ ID NO: 63;
the VH of SEQ ID NO: 52 and the VL of SEQ ID NO: 65;
the VH of SEQ ID NO: 52 and the VL of SEQ ID NO: 67;
the VH of SEQ ID NO: 52 and the VL of SEQ ID NO: 69;
the VH of SEQ ID NO: 54 and the VL of SEQ ID NO: 51;
the VH of SEQ ID NO: 54 and the VL of SEQ ID NO: 53;
the VH of SEQ ID NO: 54 and the VL of SEQ ID NO: 55;
the VH of SEQ ID NO: 54 and the VL of SEQ ID NO: 57;
the VH of SEQ ID NO: 54 and the VL of SEQ ID NO: 59;
the VH of SEQ ID NO: 54 and the VL of SEQ ID NO: 61;
the VH of SEQ ID NO: 54 and the VL of SEQ ID NO: 63;
the VH of SEQ ID NO: 54 and the VL of SEQ ID NO: 65;
the VH of SEQ ID NO: 54 and the VL of SEQ ID NO: 67;
the VH of SEQ ID NO: 54 and the VL of SEQ ID NO: 69;
the VH of SEQ ID NO: 56 and the VL of SEQ ID NO: 51;
the VH of SEQ ID NO: 56 and the VL of SEQ ID NO: 53;
the VH of SEQ ID NO: 56 and the VL of SEQ ID NO: 55;
the VH of SEQ ID NO: 56 and the VL of SEQ ID NO: 57;
the VH of SEQ ID NO: 56 and the VL of SEQ ID NO: 59;
the VH of SEQ ID NO: 56 and the VL of SEQ ID NO: 61;
the VH of SEQ ID NO: 56 and the VL of SEQ ID NO: 63;
the VH of SEQ ID NO: 56 and the VL of SEQ ID NO: 65;
the VH of SEQ ID NO: 56 and the VL of SEQ ID NO: 67;
the VH of SEQ ID NO: 56 and the VL of SEQ ID NO: 69;
the VH of SEQ ID NO: 58 and the VL of SEQ ID NO: 51;
the VH of SEQ ID NO: 58 and the VL of SEQ ID NO: 53;
the VH of SEQ ID NO: 58 and the VL of SEQ ID NO: 55;
the VH of SEQ ID NO: 58 and the VL of SEQ ID NO: 57;
the VH of SEQ ID NO: 58 and the VL of SEQ ID NO: 59;
the VH of SEQ ID NO: 58 and the VL of SEQ ID NO: 61;
the VH of SEQ ID NO: 58 and the VL of SEQ ID NO: 63;
the VH of SEQ ID NO: 58 and the VL of SEQ ID NO: 65;
the VH of SEQ ID NO: 58 and the VL of SEQ ID NO: 67;
the VH of SEQ ID NO: 58 and the VL of SEQ ID NO: 69;
the VH of SEQ ID NO: 60 and the VL of SEQ ID NO: 51;
the VH of SEQ ID NO: 60 and the VL of SEQ ID NO: 53;
the VH of SEQ ID NO: 60 and the VL of SEQ ID NO: 55;
the VH of SEQ ID NO: 60 and the VL of SEQ ID NO: 57;
the VH of SEQ ID NO: 60 and the VL of SEQ ID NO: 59;
the VH of SEQ ID NO: 60 and the VL of SEQ ID NO: 61;
the VH of SEQ ID NO: 60 and the VL of SEQ ID NO: 63;
the VH of SEQ ID NO: 60 and the VL of SEQ ID NO: 65;
the VH of SEQ ID NO: 60 and the VL of SEQ ID NO: 67;
the VH of SEQ ID NO: 60 and the VL of SEQ ID NO: 69;
the VH of SEQ ID NO: 62 and the VL of SEQ ID NO: 51;
the VH of SEQ ID NO: 62 and the VL of SEQ ID NO: 53;
the VH of SEQ ID NO: 62 and the VL of SEQ ID NO: 55;
the VH of SEQ ID NO: 62 and the VL of SEQ ID NO: 57;
the VH of SEQ ID NO: 62 and the VL of SEQ ID NO: 59;
the VH of SEQ ID NO: 62 and the VL of SEQ ID NO: 61;
the VH of SEQ ID NO: 62 and the VL of SEQ ID NO: 63;
the VH of SEQ ID NO: 62 and the VL of SEQ ID NO: 65;
the VH of SEQ ID NO: 62 and the VL of SEQ ID NO: 67;
the VH of SEQ ID NO: 62 and the VL of SEQ ID NO: 69;
the VH of SEQ ID NO: 64 and the VL of SEQ ID NO: 51;
the VH of SEQ ID NO: 64 and the VL of SEQ ID NO: 53;
the VH of SEQ ID NO: 64 and the VL of SEQ ID NO: 55;
the VH of SEQ ID NO: 64 and the VL of SEQ ID NO: 57;
the VH of SEQ ID NO: 64 and the VL of SEQ ID NO: 59;
the VH of SEQ ID NO: 64 and the VL of SEQ ID NO: 61;
the VH of SEQ ID NO: 64 and the VL of SEQ ID NO: 63;
the VH of SEQ ID NO: 64 and the VL of SEQ ID NO: 65;
the VH of SEQ ID NO: 64 and the VL of SEQ ID NO: 67;
the VH of SEQ ID NO: 64 and the VL of SEQ ID NO: 69;
the VH of SEQ ID NO: 66 and the VL of SEQ ID NO: 51;
the VH of SEQ ID NO: 66 and the VL of SEQ ID NO: 53;
the VH of SEQ ID NO: 66 and the VL of SEQ ID NO: 55;
the VH of SEQ ID NO: 66 and the VL of SEQ ID NO: 57;
the VH of SEQ ID NO: 66 and the VL of SEQ ID NO: 59;
the VH of SEQ ID NO: 66 and the VL of SEQ ID NO: 61;
the VH of SEQ ID NO: 66 and the VL of SEQ ID NO: 63;
the VH of SEQ ID NO: 66 and the VL of SEQ ID NO: 65;
the VH of SEQ ID NO: 66 and the VL of SEQ ID NO: 67;
the VH of SEQ ID NO: 66 and the VL of SEQ ID NO: 69;
the VH of SEQ ID NO: 68 and the VL of SEQ ID NO: 51;
the VH of SEQ ID NO: 68 and the VL of SEQ ID NO: 53;
the VH of SEQ ID NO: 68 and the VL of SEQ ID NO: 55;
the VH of SEQ ID NO: 68 and the VL of SEQ ID NO: 57;
the VH of SEQ ID NO: 68 and the VL of SEQ ID NO: 59;
the VH of SEQ ID NO: 68 and the VL of SEQ ID NO: 61;
the VH of SEQ ID NO: 68 and the VL of SEQ ID NO: 63;
the VH of SEQ ID NO: 68 and the VL of SEQ ID NO: 65;
the VH of SEQ ID NO: 68 and the VL of SEQ ID NO: 67;
or
the VH of SEQ ID NO: 68 and the VL of SEQ ID NO: 69.

The disclosure also provides an isolated protein comprising an antigen binding domain that binds HLA-G, wherein the antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

In some embodiments, the antigen binding domain that binds HLA-G is a scFv.

In some embodiments, the antigen binding domain that binds HLA-G is a (scFv)2.

In some embodiments, the antigen binding domain that binds HLA-G is a Fv.

In some embodiments, the antigen binding domain that binds HLA-G is a Fab.

In some embodiments, the antigen binding domain that binds HLA-G is a F(ab')2.

In some embodiments, the antigen binding domain that binds HLA-G is a Fd.

In some embodiments, the HLA-G antigen binding domain is a dAb.

In some embodiments, the HLA-G antigen binding domain is a VHH

HLA-G Binding scFvs

Any of the VH and the VL domains identified herein that bind HLA-G may be engineered into scFv format in either VH-linker-VL or VL-linker-VH orientation. Any of the VH and the VL domains identified herein may also be used to generate sc(Fv)$_2$ structures, such as VH-linker-VL-linker-VL-linker-VH, VH-linker-VL-linker-VH-linker-VL. VH-linker-VH-linker-VL-linker-VL. VL-linker-VH-linker-VH-linker-VL. VL-linker-VH-linker-VL-linker-VH or VL-linker-VL-linker-VH-linker-VH.

The VH and the VL domains identified herein may be incorporated into a scFv format and the binding and thermostability of the resulting scFv to HLA-G may be assessed using known methods. Binding may be assessed using ProteOn XPR36, Biacore 3000 or KinExA instrumentation, ELISA or competitive binding assays known to those skilled in the art. Binding may be evaluated using purified scFvs or *E coli* supernatants or lysed cells containing the expressed scFv. The measured affinity of a test scFv to HLA-G may vary if measured under different conditions (e.g., osmolarity, pH). Thus, measurements of affinity and other binding parameters (e.g., $K_D$, $K_{on}$, $K_{off}$) are typically made with standardized conditions and standardized buffers. Thermostability may be evaluated by heating the test scFv at elevated temperatures, such as at 50° C., 55° C. or 60° C. for a period of time, such as 5 minutes (min), 10 min, 15 min, 20 min, 25 min or 30 min and measuring binding of the test scFv to HLA-G. The scFvs retaining comparable binding to HLA-G when compared to a non-heated scFv sample are referred to as being thermostable.

In recombinant expression systems, the linker is a peptide linker and may include any naturally occurring amino acid. Exemplary amino acids that may be included into the linker are Gly, Ser Pro, Thr, Glu, Lys, Arg, Ile, Leu, His and The. The linker should have a length that is adequate to link the VH and the VL in such a way that they form the correct conformation relative to one another so that they retain the desired activity, such as binding to HLA-G.

The linker may be about 5-50 amino acids long. In some embodiments, the linker is about 10-40 amino acids long. In some embodiments, the linker is about 10-35 amino acids long. In some embodiments, the linker is about 10-30 amino acids long. In some embodiments, the linker is about 10-25 amino acids long. In some embodiments, the linker is about 10-20 amino acids long. In some embodiments, the linker is about 15-20 amino acids long. In some embodiments, the linker is 6 amino acids long. In some embodiments, the linker is 7 amino acids long. In some embodiments, the linker is 8 amino acids long. In some embodiments, the linker is 9 amino acids long. In some embodiments, the linker is 10 amino acids long. In some embodiments, the linker is 11 amino acids long. In some embodiments, the linker is 12 amino acids long. In some embodiments, the linker is 13 amino acids long. In some embodiments, the linker is 14 amino acids long. In some embodiments, the linker is 15 amino acids long. In some embodiments, the linker is 16 amino acids long. In some embodiments, the linker is 17 amino acids long. In some embodiments, the linker is 18 amino acids long. In some embodiments, the linker is 19 amino acids long. In some embodiments, the linker is 20 amino acids long. In some embodiments, the linker is 21 amino acids long. In some embodiments, the linker is 22 amino acids long. In some embodiments, the linker is 23 amino acids long. In some embodiments, the linker is 24 amino acids long. In some embodiments, the linker is 25 amino acids long. In some embodiments, the linker is 26 amino acids long. In some embodiments, the linker is 27 amino acids long. In some embodiments, the linker is 28 amino acids long. In some embodiments, the linker is 29 amino acids long. In some embodiments, the linker is 30 amino acids long. In some embodiments, the linker is 31 amino acids long. In some embodiments, the linker is 32 amino acids long. In some embodiments, the linker is 33 amino acids long. In some embodiments, the linker is 34 amino acids long. In some embodiments, the linker is 35 amino acids long. In some embodiments, the linker is 36 amino acids long. In some embodiments, the linker is 37 amino acids long. In some embodiments, the linker is 38 amino acids long. In some embodiments, the linker is 39 amino acids long. In some embodiments, the linker is 40 amino acids long. Exemplary linkers that may be used are Gly rich linkers, Gly and Ser containing linkers, Gly and Ala containing linkers, Ala and Ser containing linkers, and other flexible linkers.

Other linker sequences may include portions of immunoglobulin hinge area, CL or CH1 derived from any immunoglobulin heavy or light chain isotype. Alternatively, a variety of non-proteinaceous polymers, including polyethylene glycol (PEG), polypropylene glycol, polyoxyalkylenes, or copolymers of polyethylene glycol and polypropylene glycol, may find use as linkers. Exemplary linkers that may be used are shown in Table 2. Additional linkers are described for example in Int. Pat. Publ. No. WO2019/060695.

In some embodiments, the scFv comprises, from the N- to C-terminus, a VH, a first linker (L1) and a VL (VH-L1-VL).

In some embodiments, the scFv comprises, from the N- to C-terminus, the VL, the L1 and the VH (VL-L1-VH).

In some embodiments, the L1 comprises the amino acid sequence of SEQ ID NO: 8.

In some embodiments, the L1 comprises the amino acid sequence of SEQ ID NO: 9.

In some embodiments, the L1 comprises the amino acid sequence of SEQ ID NO: 10.

In some embodiments, the L1 comprises the amino acid sequence of SEQ ID NO: 11.

In some embodiments, the L1 comprises the amino acid sequence of SEQ ID NO: 12.

In some embodiments, the L1 comprises the amino acid sequence of SEQ ID NO: 13.

In some embodiments, the L1 comprises the amino acid sequence of SEQ ID NO: 14.

In some embodiments, the L1 comprises the amino acid sequence of SEQ ID NO: 15.

In some embodiments, the L1 comprises the amino acid sequence of SEQ ID NO: 16.

In some embodiments, the L1 comprises the amino acid sequence of SEQ ID NO: 17.

In some embodiments, the L1 comprises the amino acid sequence of SEQ ID NO: 18.

In some embodiments, the L1 comprises the amino acid sequence of SEQ ID NO: 19.

In some embodiments, the L1 comprises the amino acid sequence of SEQ ID NO: 20.

In some embodiments, the L1 comprises the amino acid sequence of SEQ ID NO: 21.

In some embodiments, the L1 comprises the amino acid sequence of SEQ ID NO: 22.

In some embodiments, the L1 comprises the amino acid sequence of SEQ ID NO: 23.

In some embodiments, the L1 comprises the amino acid sequence of SEQ ID NO: 24.

In some embodiments, the L1 comprises the amino acid sequence of SEQ ID NO: 25.

In some embodiments, the L1 comprises the amino acid sequence of SEQ ID NO: 26.

In some embodiments, the L1 comprises the amino acid sequence of SEQ ID NO: 27.

In some embodiments, the L1 comprises the amino acid sequence of SEQ ID NO: 28.

In some embodiments, the L1 comprises the amino acid sequence of SEQ ID NO: 29.

In some embodiments, the L1 comprises the amino acid sequence of SEQ ID NO: 30.

In some embodiments, the L1 comprises the amino acid sequence of SEQ ID NO: 31.

In some embodiments, the L1 comprises the amino acid sequence of SEQ ID NO: 32.

In some embodiments, the L1 comprises the amino acid sequence of SEQ ID NO: 33.

In some embodiments, the L1 comprises the amino acid sequence of SEQ ID NO: 34.
In some embodiments, the L1 comprises the amino acid sequence of SEQ ID NO: 35.
In some embodiments, the L1 comprises the amino acid sequence of SEQ ID NO: 36.
In some embodiments, the L1 comprises the amino acid sequence of SEQ ID NO: 37.
In some embodiments, the L1 comprises the amino acid sequence of SEQ ID NO: 38.
In some embodiments, the L1 comprises the amino acid sequence of SEQ ID NO: 39.
In some embodiments, the L1 comprises the amino acid sequence of SEQ ID NO: 40.

TABLE 2

Linkers.

| Linker name | Amino acid sequence | SEQ ID NO: |
|---|---|---|
| Linker 1 | GGSEGKSSGSGSESKSTGGS | 8 |
| Linker 2 | GGGSGGGS | 9 |
| Linker 3 | GGGSGGGSGGGS | 10 |
| Linker 4 | GGGSGGGSGGGSGGGS | 11 |
| Linker 5 | GGGSGGGSGGGSGGGSGGGS | 12 |
| Linker 6 | GGGGSGGGGSGGGGS | 13 |
| Linker 7 | GGGGSGGGGSGGGGSGGGGS | 14 |
| Linker 8 | GGGGSGGGGSGGGGSGGGGSGGGGS | 15 |
| Linker 9 | GSTSGSGKPGSGEGSTKG | 16 |
| Linker 10 | IRPRAIGGSKPRVA | 17 |
| Linker 11 | GKGGSGKGGSGKGGS | 18 |
| Linker 12 | GGKGSGGKGSGGKGS | 19 |
| Linker 13 | GGGKSGGGKSGGGKS | 20 |
| Linker 14 | GKGKSGKGKSGKGKS | 21 |
| Linker 15 | GGGKSGGKGSGKGGS | 22 |
| Linker 16 | GKPGSGKPGSGKPGS | 23 |
| Linker 17 | GKPGSGKPGSGKPGSGKPGS | 24 |
| Linker 18 | GKGKSGKGKSGKGKSGKGKS | 25 |
| Linker 19 | STAGDTHLGGEDFD | 26 |
| Linker 20 | GEGGSGEGGSGEGGS | 27 |
| Linker 21 | GGEGSGGEGSGGEGS | 28 |
| Linker 22 | GEGESGEGESGEGES | 29 |
| Linker 23 | GGGESGGEGSGEGGS | 30 |
| Linker 24 | GEGESGEGESGEGESGEGES | 31 |
| Linker 25 | GSTSGSGKPGSGEGSTKG | 32 |
| Linker 26 | PRGASKSGSASQTGSAPGS | 33 |
| Linker 27 | GTAAAGAGAAGGAAAGAAG | 34 |
| Linker 28 | GTSGSSGSGSGGSGSGGG | 35 |

TABLE 2-continued

Linkers.

| Linker name | Amino acid sequence | SEQ ID NO: |
|---|---|---|
| Linker 29 | GKPGSGKPGSGKPGSGKPGS | 36 |
| Linker 30 | GSGS | 37 |
| Linker 31 | APAPAPAPAP | 38 |
| Linker 32 | APAPAPAPAPAPAPAPAP | 39 |
| Linker 33 | AEAAAKEAAAKEAAAAKEAAAAKEAAAAKAAA | 40 |
| Linker 34 | GTEGKSSGSGSESKST | 376 |

In some embodiments, the scFv comprises
a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or
the HCDR1, the HCDR2 and the HCDR3 of the VH of SEQ ID NO: 52 and the LCDR1, the LCDR2 and the LCDR3 of the VL of SEQ ID NO: 53; or
the HCDR1, the HCDR2 and the HCDR3 of the VH of SEQ ID NO: 54 and the LCDR1, the LCDR2 and the LCDR3 of the VL of SEQ ID NO: 55; or
the HCDR1, the HCDR2 and the HCDR3 of the VH of SEQ ID NO: 56 and the LCDR1, the LCDR2 and the LCDR3 of the VL of SEQ ID NO: 57; or
the HCDR1, the HCDR2 and the HCDR3 of the VH of SEQ ID NO: 58 and the LCDR1, the LCDR2 and the LCDR3 of the VL of SEQ ID NO: 59; or
the HCDR1, the HCDR2 and the HCDR3 of the VH of SEQ ID NO: 60 and the LCDR1, the LCDR2 and the LCDR3 of the VL of SEQ ID NO: 61; or
the HCDR1, the HCDR2 and the HCDR3 of the VH of SEQ ID NO: 62 and the LCDR1, the LCDR2 and the LCDR3 of the VL of SEQ ID NO: 63; or
the HCDR1, the HCDR2 and the HCDR3 of the VH of SEQ ID NO: 64 and the LCDR1, the LCDR2 and the LCDR3 of the VL of SEQ ID NO: 65; or
the HCDR1, the HCDR2 and the HCDR3 of the VH of SEQ ID NO: 66 and the LCDR1, the LCDR2 and the LCDR3 of the VL of SEQ ID NO: 67; or
the HCDR1, the HCDR2 and the HCDR3 of the VH of SEQ ID NO: 68 and the LCDR1, the LCDR2 and the LCDR3 of the VL of SEQ ID NO: 69.

In some embodiments, the scFv comprises the HCDR1, the HCDR2, the HCDR3, the LCDR1, the LCDR2 and the LCDR3 of
SEQ ID NOs: 70, 71, 72, 88, 89, and 90, respectively;
SEQ ID NOs: 73, 71, 74, 91, 89, and 92, respectively;
SEQ ID NOs: 75, 76, 77, 93, 89, and 94, respectively;
SEQ ID NOs: 78, 79, 80, 95, 89, and 96, respectively;
SEQ ID NOs: 81, 82, 83, 97, 89, and 98, respectively;
SEQ ID NOs: 78, 71, 84, 99, 89, and 100, respectively;
SEQ ID NOs: 78, 71, 84, 101, 89, and 100, respectively;
SEQ ID NOs: 85, 86, 87, 102, 103, and 104, respectively; or
SEQ ID NOs: 78, 71, 84, 95, 89, and 96, respectively.

In some embodiments, the scFv comprises the HCDR1, the HCDR2, the HCDR3, the LCDR1, the LCDR2 and the LCDR3 of SEQ ID NOs: 70, 71, 72, 88, 89, and 90, respectively.

In some embodiments, the scFv comprises the HCDR1, the HCDR2, the HCDR3, the LCDR1, the LCDR2 and the LCDR3 of SEQ ID NOs: 73, 71, 74, 91, 89, and 92, respectively.

In some embodiments, the scFv comprises the HCDR1, the HCDR2, the HCDR3, the LCDR1, the LCDR2 and the LCDR3 of SEQ ID NOs: 75, 76, 77, 93, 89, and 94, respectively.

In some embodiments, the scFv comprises the HCDR1, the HCDR2, the HCDR3, the LCDR1, the LCDR2 and the LCDR3 of SEQ ID NOs: 78, 79, 80, 95, 89, and 96, respectively.

In some embodiments, the scFv comprises the HCDR1, the HCDR2, the HCDR3, the LCDR1, the LCDR2 and the LCDR3 of SEQ ID NOs: 81, 82, 83, 97, 89, and 98, respectively.

In some embodiments, the scFv comprises the HCDR1, the HCDR2, the HCDR3, the LCDR1, the LCDR2 and the LCDR3 of SEQ ID NOs: 78, 71, 84, 99, 89, and 100, respectively.

In some embodiments, the scFv comprises the HCDR1, the HCDR2, the HCDR3, the LCDR1, the LCDR2 and the LCDR3 of SEQ ID NOs: 78, 71, 84, 101, 89, and 100, respectively.

In some embodiments, the scFv comprises the HCDR1, the HCDR2, the HCDR3, the LCDR1, the LCDR2 and the LCDR3 of SEQ ID NOs: 85, 86, 87, 102, 103, and 104, respectively.

In some embodiments, the scFv comprises the HCDR1, the HCDR2, the HCDR3, the LCDR1, the LCDR2 and the LCDR3 of SEQ ID NOs: 78, 71, 84, 95, 89, and 96, respectively.

In some embodiments, the scFv comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

In some embodiments, the scFv comprises the VH of SEQ ID NO: 50 and the VL of SEQ ID NO: 51.

In some embodiments, the scFv comprises the VH of SEQ ID NO: 52 and the VL of SEQ ID NO: 53.

In some embodiments, the scFv comprises the VH of SEQ ID NO: 54 and the VL of SEQ ID NO: 55.

In some embodiments, the scFv comprises the VH of SEQ ID NO: 56 and the VL of SEQ ID NO: 57.

In some embodiments, the scFv comprises the VH of SEQ ID NO: 58 and the VL of SEQ ID NO: 59.

In some embodiments, the scFv comprises the VH of SEQ ID NO: 60 and the VL of SEQ ID NO: 61.

In some embodiments, the scFv comprises the VH of SEQ ID NO: 62 and the VL of SEQ ID NO: 63.

In some embodiments, the scFv comprises the VH of SEQ ID NO: 64 and the VL of SEQ ID NO: 65.

In some embodiments, the scFv comprises the VH of SEQ ID NO: 66 and the VL of SEQ ID NO: 67.

In some embodiments, the scFv comprises the VH of SEQ ID NO: 68 and the VL of SEQ ID NO: 69.

In some embodiments, the scFv comprises the VH of SEQ ID NO: 50 and the VL of SEQ ID NO: 51.

In some embodiments, the scFv comprises the VH of SEQ ID NO: 50 and the VL of SEQ ID NO: 53.

In some embodiments, the scFv comprises the VH of SEQ ID NO: 50 and the VL of SEQ ID NO: 55.

In some embodiments, the scFv comprises the VH of SEQ ID NO: 50 and the VL of SEQ ID NO: 57.

In some embodiments, the scFv comprises the VH of SEQ ID NO: 50 and the VL of SEQ ID NO: 59.

In some embodiments, the scFv comprises the VH of SEQ ID NO: 50 and the VL of SEQ ID NO: 61.

In some embodiments, the scFv comprises the VH of SEQ ID NO: 50 and the VL of SEQ ID NO: 63.

In some embodiments, the scFv comprises the VH of SEQ ID NO: 50 and the VL of SEQ ID NO: 65.

In some embodiments, the scFv comprises the VH of SEQ ID NO: 50 and the VL of SEQ ID NO: 67.

In some embodiments, the scFv comprises the VH of SEQ ID NO: 50 and the VL of SEQ ID NO: 69.

In some embodiments, the scFv comprises the VH of SEQ ID NO: 52 and the VL of SEQ ID NO: 51.

In some embodiments, the scFv comprises the VH of SEQ ID NO: 52 and the VL of SEQ ID NO: 53.

In some embodiments, the scFv comprises the VH of SEQ ID NO: 52 and the VL of SEQ ID NO: 55.

In some embodiments, the scFv comprises the VH of SEQ ID NO: 52 and the VL of SEQ ID NO: 57.

In some embodiments, the scFv comprises the VH of SEQ ID NO: 52 and the VL of SEQ ID NO: 59.

In some embodiments, the scFv comprises the VH of SEQ ID NO: 52 and the VL of SEQ ID NO: 61.

In some embodiments, the scFv comprises the VH of SEQ ID NO: 52 and the VL of SEQ ID NO: 63.

In some embodiments, the scFv comprises the VH of SEQ ID NO: 52 and the VL of SEQ ID NO: 65.

In some embodiments, the scFv comprises the VH of SEQ ID NO: 52 and the VL of SEQ ID NO: 67.

In some embodiments, the scFv comprises the VH of SEQ ID NO: 52 and the VL of SEQ ID NO: 69.

In some embodiments, the scFv comprises the VH of SEQ ID NO: 54 and the VL of SEQ ID NO: 51.

In some embodiments, the scFv comprises the VH of SEQ ID NO: 54 and the VL of SEQ ID NO: 53.

In some embodiments, the scFv comprises the VH of SEQ ID NO: 54 and the VL of SEQ ID NO: 55.

In some embodiments, the scFv comprises the VH of SEQ ID NO: 54 and the VL of SEQ ID NO: 57.

In some embodiments, the scFv comprises the VH of SEQ ID NO: 54 and the VL of SEQ ID NO: 59.

In some embodiments, the scFv comprises the VH of SEQ ID NO: 54 and the VL of SEQ ID NO: 61.

In some embodiments, the scFv comprises the VH of SEQ ID NO: 54 and the VL of SEQ ID NO: 63.

In some embodiments, the scFv comprises the VH of SEQ ID NO: 54 and the VL of SEQ ID NO: 65.

In some embodiments, the scFv comprises the VH of SEQ ID NO: 54 and the VL of SEQ ID NO: 67.

In some embodiments, the scFv comprises the VH of SEQ ID NO: 54 and the VL of SEQ ID NO: 69.

In some embodiments, the scFv comprises the VH of SEQ ID NO: 56 and the VL of SEQ ID NO: 51.

In some embodiments, the scFv comprises the VH of SEQ ID NO: 56 and the VL of SEQ ID NO: 53.

In some embodiments, the scFv comprises the VH of SEQ ID NO: 56 and the VL of SEQ ID NO: 55.

In some embodiments, the scFv comprises the VH of SEQ ID NO: 56 and the VL of SEQ ID NO: 57.

In some embodiments, the scFv comprises the VH of SEQ ID NO: 56 and the VL of SEQ ID NO: 59.

In some embodiments, the scFv comprises the VH of SEQ ID NO: 56 and the VL of SEQ ID NO: 61.

In some embodiments, the scFv comprises the VH of SEQ ID NO: 56 and the VL of SEQ ID NO: 63.

In some embodiments, the scFv comprises the VH of SEQ ID NO: 56 and the VL of SEQ ID NO: 65.
In some embodiments, the scFv comprises the VH of SEQ ID NO: 56 and the VL of SEQ ID NO: 67.
In some embodiments, the scFv comprises the VH of SEQ ID NO: 56 and the VL of SEQ ID NO: 69.
In some embodiments, the scFv comprises the VH of SEQ ID NO: 58 and the VL of SEQ ID NO: 51.
In some embodiments, the scFv comprises the VH of SEQ ID NO: 58 and the VL of SEQ ID NO: 53.
In some embodiments, the scFv comprises the VH of SEQ ID NO: 58 and the VL of SEQ ID NO: 55.
In some embodiments, the scFv comprises the VH of SEQ ID NO: 58 and the VL of SEQ ID NO: 57.
In some embodiments, the scFv comprises the VH of SEQ ID NO: 58 and the VL of SEQ ID NO: 59.
In some embodiments, the scFv comprises the VH of SEQ ID NO: 58 and the VL of SEQ ID NO: 61.
In some embodiments, the scFv comprises the VH of SEQ ID NO: 58 and the VL of SEQ ID NO: 63.
In some embodiments, the scFv comprises the VH of SEQ ID NO: 58 and the VL of SEQ ID NO: 65.
In some embodiments, the scFv comprises the VH of SEQ ID NO: 58 and the VL of SEQ ID NO: 67.
In some embodiments, the scFv comprises the VH of SEQ ID NO: 58 and the VL of SEQ ID NO: 69.
In some embodiments, the scFv comprises the VH of SEQ ID NO: 60 and the VL of SEQ ID NO: 51.
In some embodiments, the scFv comprises the VH of SEQ ID NO: 60 and the VL of SEQ ID NO: 53.
In some embodiments, the scFv comprises the VH of SEQ ID NO: 60 and the VL of SEQ ID NO: 55.
In some embodiments, the scFv comprises the VH of SEQ ID NO: 60 and the VL of SEQ ID NO: 57.
In some embodiments, the scFv comprises the VH of SEQ ID NO: 60 and the VL of SEQ ID NO: 59.
In some embodiments, the scFv comprises the VH of SEQ ID NO: 60 and the VL of SEQ ID NO: 61.
In some embodiments, the scFv comprises the VH of SEQ ID NO: 60 and the VL of SEQ ID NO: 63.
In some embodiments, the scFv comprises the VH of SEQ ID NO: 60 and the VL of SEQ ID NO: 65.
In some embodiments, the scFv comprises the VH of SEQ ID NO: 60 and the VL of SEQ ID NO: 67.
In some embodiments, the scFv comprises the VH of SEQ ID NO: 60 and the VL of SEQ ID NO: 69.
In some embodiments, the scFv comprises the VH of SEQ ID NO: 62 and the VL of SEQ ID NO: 51.
In some embodiments, the scFv comprises the VH of SEQ ID NO: 62 and the VL of SEQ ID NO: 53.
In some embodiments, the scFv comprises the VH of SEQ ID NO: 62 and the VL of SEQ ID NO: 55.
In some embodiments, the scFv comprises the VH of SEQ ID NO: 62 and the VL of SEQ ID NO: 57.
In some embodiments, the scFv comprises the VH of SEQ ID NO: 62 and the VL of SEQ ID NO: 59.
In some embodiments, the scFv comprises the VH of SEQ ID NO: 62 and the VL of SEQ ID NO: 61.
In some embodiments, the scFv comprises the VH of SEQ ID NO: 62 and the VL of SEQ ID NO: 63.
In some embodiments, the scFv comprises the VH of SEQ ID NO: 62 and the VL of SEQ ID NO: 65.
In some embodiments, the scFv comprises the VH of SEQ ID NO: 62 and the VL of SEQ ID NO: 67.
In some embodiments, the scFv comprises the VH of SEQ ID NO: 62 and the VL of SEQ ID NO: 69.
In some embodiments, the scFv comprises the VH of SEQ ID NO: 64 and the VL of SEQ ID NO: 51.
In some embodiments, the scFv comprises the VH of SEQ ID NO: 64 and the VL of SEQ ID NO: 53.
In some embodiments, the scFv comprises the VH of SEQ ID NO: 64 and the VL of SEQ ID NO: 55.
In some embodiments, the scFv comprises the VH of SEQ ID NO: 64 and the VL of SEQ ID NO: 57.
In some embodiments, the scFv comprises the VH of SEQ ID NO: 64 and the VL of SEQ ID NO: 59.
In some embodiments, the scFv comprises the VH of SEQ ID NO: 64 and the VL of SEQ ID NO: 61.
In some embodiments, the scFv comprises the VH of SEQ ID NO: 64 and the VL of SEQ ID NO: 63.
In some embodiments, the scFv comprises the VH of SEQ ID NO: 64 and the VL of SEQ ID NO: 65.
In some embodiments, the scFv comprises the VH of SEQ ID NO: 64 and the VL of SEQ ID NO: 67.
In some embodiments, the scFv comprises the VH of SEQ ID NO: 64 and the VL of SEQ ID NO: 69.
In some embodiments, the scFv comprises the VH of SEQ ID NO: 66 and the VL of SEQ ID NO: 51.
In some embodiments, the scFv comprises the VH of SEQ ID NO: 66 and the VL of SEQ ID NO: 53.
In some embodiments, the scFv comprises the VH of SEQ ID NO: 66 and the VL of SEQ ID NO: 55.
In some embodiments, the scFv comprises the VH of SEQ ID NO: 66 and the VL of SEQ ID NO: 57.
In some embodiments, the scFv comprises the VH of SEQ ID NO: 66 and the VL of SEQ ID NO: 59.
In some embodiments, the scFv comprises the VH of SEQ ID NO: 66 and the VL of SEQ ID NO: 61.
In some embodiments, the scFv comprises the VH of SEQ ID NO: 66 and the VL of SEQ ID NO: 63.
In some embodiments, the scFv comprises the VH of SEQ ID NO: 66 and the VL of SEQ ID NO: 65.
In some embodiments, the scFv comprises the VH of SEQ ID NO: 66 and the VL of SEQ ID NO: 67.
In some embodiments, the scFv comprises the VH of SEQ ID NO: 66 and the VL of SEQ ID NO: 69.
In some embodiments, the scFv comprises the VH of SEQ ID NO: 68 and the VL of SEQ ID NO: 51.
In some embodiments, the scFv comprises the VH of SEQ ID NO: 68 and the VL of SEQ ID NO: 53.
In some embodiments, the scFv comprises the VH of SEQ ID NO: 68 and the VL of SEQ ID NO: 55.
In some embodiments, the scFv comprises the VH of SEQ ID NO: 68 and the VL of SEQ ID NO: 57.
In some embodiments, the scFv comprises the VH of SEQ ID NO: 68 and the VL of SEQ ID NO: 59.
In some embodiments, the scFv comprises the VH of SEQ ID NO: 68 and the VL of SEQ ID NO: 61.
In some embodiments, the scFv comprises the VH of SEQ ID NO: 68 and the VL of SEQ ID NO: 63.
In some embodiments, the scFv comprises the VH of SEQ ID NO: 68 and the VL of SEQ ID NO: 65.
In some embodiments, the scFv comprises the VH of SEQ ID NO: 68 and the VL of SEQ ID NO: 67.
In some embodiments, the scFv comprises the VH of SEQ ID NO: 68 and the VL of SEQ ID NO: 69.
In some embodiments, the scFv comprises the amino acid sequence of SEQ ID NO: 248.
In some embodiments, the scFv comprises the amino acid sequence of SEQ ID NO: 249.
In some embodiments, the scFv comprises the amino acid sequence of SEQ ID NO: 250.

In some embodiments, the scFv comprises the amino acid sequence of SEQ ID NO: 251.

In some embodiments, the scFv comprises the amino acid sequence of SEQ ID NO: 252.

In some embodiments, the scFv comprises the amino acid sequence of SEQ ID NO: 253.

In some embodiments, the scFv comprises the amino acid sequence of SEQ ID NO: 254.

In some embodiments, the scFv comprises the amino acid sequence of SEQ ID NO: 255.

In some embodiments, the scFv comprises the amino acid sequence of SEQ ID NO: 256.

In some embodiments, the scFv comprises the amino acid sequence of SEQ ID NO: 257.

In some embodiments, the scFv comprises the amino acid sequence of SEQ ID NO: 258.

In some embodiments, the scFv comprises the amino acid sequence of SEQ ID NO: 259.

In some embodiments, the scFv comprises the amino acid sequence of SEQ ID NO: 260.

In some embodiments, the scFv comprises the amino acid sequence of SEQ ID NO: 261.

In some embodiments, the scFv comprises the amino acid sequence of SEQ ID NO: 262.

In some embodiments, the scFv comprises the amino acid sequence of SEQ ID NO: 263.

In some embodiments, the scFv comprises the amino acid sequence of SEQ ID NO: 264.

In some embodiments, the scFv comprises the amino acid sequence of SEQ ID NO: 265.

In some embodiments, the scFv comprises the amino acid sequence of SEQ ID NO: 266.

In some embodiments, the scFv comprises the amino acid sequence of SEQ ID NO: 267.

In some embodiments, the scFv comprises the amino acid sequence of SEQ ID NO: 268.

In some embodiments, the scFv comprises the amino acid sequence of SEQ ID NO: 269.

Other Antigen Binding Domains that Bind HLA-G

Any of the VH and the VL domains identified herein that bind HLA-G may also be engineered into Fab, F(ab')$_2$, Fd or Fv format and their binding to HLA-G and thermostability may be assessed using the assays described herein.

In some embodiments, the Fab comprises
a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or
the HCDR1, the HCDR2 and the HCDR3 of the VH of SEQ ID NO: 52 and the LCDR1, the LCDR2 and the LCDR3 of the VL of SEQ ID NO: 53; or
the HCDR1, the HCDR2 and the HCDR3 of the VH of SEQ ID NO: 54 and the LCDR1, the LCDR2 and the LCDR3 of the VL of SEQ ID NO: 55; or
the HCDR1, the HCDR2 and the HCDR3 of the VH of SEQ ID NO: 56 and the LCDR1, the LCDR2 and the LCDR3 of the VL of SEQ ID NO: 57; or
the HCDR1, the HCDR2 and the HCDR3 of the VH of SEQ ID NO: 58 and the LCDR1, the LCDR2 and the LCDR3 of the VL of SEQ ID NO: 59; or
the HCDR1, the HCDR2 and the HCDR3 of the VH of SEQ ID NO: 60 and the LCDR1, the LCDR2 and the LCDR3 of the VL of SEQ ID NO: 61; or
the HCDR1, the HCDR2 and the HCDR3 of the VH of SEQ ID NO: 62 and the LCDR1, the LCDR2 and the LCDR3 of the VL of SEQ ID NO: 63; or
the HCDR1, the HCDR2 and the HCDR3 of the VH of SEQ ID NO: 64 and the LCDR1, the LCDR2 and the LCDR3 of the VL of SEQ ID NO: 65; or
the HCDR1, the HCDR2 and the HCDR3 of the VH of SEQ ID NO: 66 and the LCDR1, the LCDR2 and the LCDR3 of the VL of SEQ ID NO: 67; or
the HCDR1, the HCDR2 and the HCDR3 of the VH of SEQ ID NO: 68 and the LCDR1, the LCDR2 and the LCDR3 of the VL of SEQ ID NO: 69.

In some embodiments, the Fab comprises the HCDR1, the HCDR2, the HCDR3, the LCDR1, the LCDR2 and the LCDR3 of
SEQ ID NOs: 70, 71, 72, 88, 89, and 90, respectively;
SEQ ID NOs: 73, 71, 74, 91, 89, and 92, respectively;
SEQ ID NOs: 75, 76, 77, 93, 89, and 94, respectively;
SEQ ID NOs: 78, 79, 80, 95, 89, and 96, respectively;
SEQ ID NOs: 81, 82, 83, 97, 89, and 98, respectively;
SEQ ID NOs: 78, 71, 84, 99, 89, and 100, respectively;
SEQ ID NOs: 78, 71, 84, 101, 89, and 100, respectively;
SEQ ID NOs: 85, 86, 87, 102, 103, and 104, respectively; or
SEQ ID NOs: 78, 71, 84, 95, 89, and 96, respectively.

In some embodiments, the Fab comprises the HCDR1, the HCDR2, the HCDR3, the LCDR1, the LCDR2 and the LCDR3 of SEQ ID NOs: 70, 71, 72, 88, 89, and 90, respectively.

In some embodiments, the Fab comprises the HCDR1, the HCDR2, the HCDR3, the LCDR1, the LCDR2 and the LCDR3 of SEQ ID NOs: 73, 71, 74, 91, 89, and 92, respectively.

In some embodiments, the Fab comprises the HCDR1, the HCDR2, the HCDR3, the LCDR1, the LCDR2 and the LCDR3 of SEQ ID NOs: 75, 76, 77, 93, 89, and 94, respectively.

In some embodiments, the Fab comprises the HCDR1, the HCDR2, the HCDR3, the LCDR1, the LCDR2 and the LCDR3 of SEQ ID NOs: 78, 79, 80, 95, 89, and 96, respectively.

In some embodiments, the Fab comprises the HCDR1, the HCDR2, the HCDR3, the LCDR1, the LCDR2 and the LCDR3 of SEQ ID Nos: 81, 82, 83, 97, 89, and 98, respectively.

In some embodiments, the Fab comprises the HCDR1, the HCDR2, the HCDR3, the LCDR1, the LCDR2 and the LCDR3 of SEQ ID NOs: 78, 71, 84, 99, 89, and 100, respectively.

In some embodiments, the Fab comprises the HCDR1, the HCDR2, the HCDR3, the LCDR1, the LCDR2 and the LCDR3 of SEQ ID NOs: 78, 71, 84, 101, 89, and 100, respectively.

In some embodiments, the Fab comprises the HCDR1, the HCDR2, the HCDR3, the LCDR1, the LCDR2 and the LCDR3 of SEQ ID NOs: 85, 86, 87, 102, 103, and 104, respectively.

In some embodiments, the Fab comprises the HCDR1, the HCDR2, the HCDR3, the LCDR1, the LCDR2 and the LCDR3 of SEQ ID NOs: 78, 71, 84, 95, 89, and 96, respectively.

In some embodiments, the Fab comprises the VH of SEQ ID NO: 50 and the VL of SEQ ID NO: 51.

In some embodiments, the Fab comprises the VH of SEQ ID NO: 52 and the VL of SEQ ID NO: 53.

In some embodiments, the Fab comprises the VH of SEQ ID NO: 54 and the VL of SEQ ID NO: 55.

In some embodiments, the Fab comprises the VH of SEQ ID NO: 56 and the VL of SEQ ID NO: 57.
In some embodiments, the Fab comprises the VH of SEQ ID NO: 58 and the VL of SEQ ID NO: 59.
In some embodiments, the Fab comprises the VH of SEQ ID NO: 60 and the VL of SEQ ID NO: 61.
In some embodiments, the Fab comprises the VH of SEQ ID NO: 62 and the VL of SEQ ID NO: 63.
In some embodiments, the Fab comprises the VH of SEQ ID NO: 64 and the VL of SEQ ID NO: 65.
In some embodiments, the Fab comprises the VH of SEQ ID NO: 66 and the VL of SEQ ID NO: 67.
In some embodiments, the Fab comprises the VH of SEQ ID NO: 68 and the VL of SEQ ID NO: 69.
In some embodiments, the Fab comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.
In some embodiments, the Fab comprises the VH of SEQ ID NO: 50 and the VL of SEQ ID NO: 51.
In some embodiments, the Fab comprises the VH of SEQ ID NO: 50 and the VL of SEQ ID NO: 53.
In some embodiments, the Fab comprises the VH of SEQ ID NO: 50 and the VL of SEQ ID NO: 55.
In some embodiments, the Fab comprises the VH of SEQ ID NO: 50 and the VL of SEQ ID NO: 57.
In some embodiments, the Fab comprises the VH of SEQ ID NO: 50 and the VL of SEQ ID NO: 59.
In some embodiments, the Fab comprises the VH of SEQ ID NO: 50 and the VL of SEQ ID NO: 61.
In some embodiments, the Fab comprises the VH of SEQ ID NO: 50 and the VL of SEQ ID NO: 63.
In some embodiments, the Fab comprises the VH of SEQ ID NO: 50 and the VL of SEQ ID NO: 65.
In some embodiments, the Fab comprises the VH of SEQ ID NO: 50 and the VL of SEQ ID NO: 67.
In some embodiments, the Fab comprises the VH of SEQ ID NO: 50 and the VL of SEQ ID NO: 69.
In some embodiments, the Fab comprises the VH of SEQ ID NO: 52 and the VL of SEQ ID NO: 51.
In some embodiments, the Fab comprises the VH of SEQ ID NO: 52 and the VL of SEQ ID NO: 53.
In some embodiments, the Fab comprises the VH of SEQ ID NO: 52 and the VL of SEQ ID NO: 55.
In some embodiments, the Fab comprises the VH of SEQ ID NO: 52 and the VL of SEQ ID NO: 57.
In some embodiments, the Fab comprises the VH of SEQ ID NO: 52 and the VL of SEQ ID NO: 59.
In some embodiments, the Fab comprises the VH of SEQ ID NO: 52 and the VL of SEQ ID NO: 61.
In some embodiments, the Fab comprises the VH of SEQ ID NO: 52 and the VL of SEQ ID NO: 63.
In some embodiments, the Fab comprises the VH of SEQ ID NO: 52 and the VL of SEQ ID NO: 65.
In some embodiments, the Fab comprises the VH of SEQ ID NO: 52 and the VL of SEQ ID NO: 67.
In some embodiments, the Fab comprises the VH of SEQ ID NO: 52 and the VL of SEQ ID NO: 69.
In some embodiments, the Fab comprises the VH of SEQ ID NO: 54 and the VL of SEQ ID NO: 51.
In some embodiments, the Fab comprises the VH of SEQ ID NO: 54 and the VL of SEQ ID NO: 53.
In some embodiments, the Fab comprises the VH of SEQ ID NO: 54 and the VL of SEQ ID NO: 55.
In some embodiments, the Fab comprises the VH of SEQ ID NO: 54 and the VL of SEQ ID NO: 57.
In some embodiments, the Fab comprises the VH of SEQ ID NO: 54 and the VL of SEQ ID NO: 59.
In some embodiments, the Fab comprises the VH of SEQ ID NO: 54 and the VL of SEQ ID NO: 61.
In some embodiments, the Fab comprises the VH of SEQ ID NO: 54 and the VL of SEQ ID NO: 63.
In some embodiments, the Fab comprises the VH of SEQ ID NO: 54 and the VL of SEQ ID NO: 65.
In some embodiments, the Fab comprises the VH of SEQ ID NO: 54 and the VL of SEQ ID NO: 67.
In some embodiments, the Fab comprises the VH of SEQ ID NO: 54 and the VL of SEQ ID NO: 69.
In some embodiments, the Fab comprises the VH of SEQ ID NO: 56 and the VL of SEQ ID NO: 51.
In some embodiments, the Fab comprises the VH of SEQ ID NO: 56 and the VL of SEQ ID NO: 53.
In some embodiments, the Fab comprises the VH of SEQ ID NO: 56 and the VL of SEQ ID NO: 55.
In some embodiments, the Fab comprises the VH of SEQ ID NO: 56 and the VL of SEQ ID NO: 57.
In some embodiments, the Fab comprises the VH of SEQ ID NO: 56 and the VL of SEQ ID NO: 59.
In some embodiments, the Fab comprises the VH of SEQ ID NO: 56 and the VL of SEQ ID NO: 61.
In some embodiments, the Fab comprises the VH of SEQ ID NO: 56 and the VL of SEQ ID NO: 63.
In some embodiments, the Fab comprises the VH of SEQ ID NO: 56 and the VL of SEQ ID NO: 65.
In some embodiments, the Fab comprises the VH of SEQ ID NO: 56 and the VL of SEQ ID NO: 67.
In some embodiments, the Fab comprises the VH of SEQ ID NO: 56 and the VL of SEQ ID NO: 69.
In some embodiments, the Fab comprises the VH of SEQ ID NO: 58 and the VL of SEQ ID NO: 51.
In some embodiments, the Fab comprises the VH of SEQ ID NO: 58 and the VL of SEQ ID NO: 53.
In some embodiments, the Fab comprises the VH of SEQ ID NO: 58 and the VL of SEQ ID NO: 55.
In some embodiments, the Fab comprises the VH of SEQ ID NO: 58 and the VL of SEQ ID NO: 57.
In some embodiments, the Fab comprises the VH of SEQ ID NO: 58 and the VL of SEQ ID NO: 59.
In some embodiments, the Fab comprises the VH of SEQ ID NO: 58 and the VL of SEQ ID NO: 61.
In some embodiments, the Fab comprises the VH of SEQ ID NO: 58 and the VL of SEQ ID NO: 63.
In some embodiments, the Fab comprises the VH of SEQ ID NO: 58 and the VL of SEQ ID NO: 65.
In some embodiments, the Fab comprises the VH of SEQ ID NO: 58 and the VL of SEQ ID NO: 67.
In some embodiments, the Fab comprises the VH of SEQ ID NO: 58 and the VL of SEQ ID NO: 69.
In some embodiments, the Fab comprises the VH of SEQ ID NO: 60 and the VL of SEQ ID NO: 51.
In some embodiments, the Fab comprises the VH of SEQ ID NO: 60 and the VL of SEQ ID NO: 53.
In some embodiments, the Fab comprises the VH of SEQ ID NO: 60 and the VL of SEQ ID NO: 55.
In some embodiments, the Fab comprises the VH of SEQ ID NO: 60 and the VL of SEQ ID NO: 57.
In some embodiments, the Fab comprises the VH of SEQ ID NO: 60 and the VL of SEQ ID NO: 59.
In some embodiments, the Fab comprises the VH of SEQ ID NO: 60 and the VL of SEQ ID NO: 61.
In some embodiments, the Fab comprises the VH of SEQ ID NO: 60 and the VL of SEQ ID NO: 63.
In some embodiments, the Fab comprises the VH of SEQ ID NO: 60 and the VL of SEQ ID NO: 65.

In some embodiments, the Fab comprises the VH of SEQ ID NO: 60 and the VL of SEQ ID NO: 67.

In some embodiments, the Fab comprises the VH of SEQ ID NO: 60 and the VL of SEQ ID NO: 69.

In some embodiments, the Fab comprises the VH of SEQ ID NO: 62 and the VL of SEQ ID NO: 51.

In some embodiments, the Fab comprises the VH of SEQ ID NO: 62 and the VL of SEQ ID NO: 53.

In some embodiments, the Fab comprises the VH of SEQ ID NO: 62 and the VL of SEQ ID NO: 55.

In some embodiments, the Fab comprises the VH of SEQ ID NO: 62 and the VL of SEQ ID NO: 57.

In some embodiments, the Fab comprises the VH of SEQ ID NO: 62 and the VL of SEQ ID NO: 59.

In some embodiments, the Fab comprises the VH of SEQ ID NO: 62 and the VL of SEQ ID NO: 61.

In some embodiments, the Fab comprises the VH of SEQ ID NO: 62 and the VL of SEQ ID NO: 63.

In some embodiments, the Fab comprises the VH of SEQ ID NO: 62 and the VL of SEQ ID NO: 65.

In some embodiments, the Fab comprises the VH of SEQ ID NO: 62 and the VL of SEQ ID NO: 67.

In some embodiments, the Fab comprises the VH of SEQ ID NO: 62 and the VL of SEQ ID NO: 69.

In some embodiments, the Fab comprises the VH of SEQ ID NO: 64 and the VL of SEQ ID NO: 51.

In some embodiments, the Fab comprises the VH of SEQ ID NO: 64 and the VL of SEQ ID NO: 53.

In some embodiments, the Fab comprises the VH of SEQ ID NO: 64 and the VL of SEQ ID NO: 55.

In some embodiments, the Fab comprises the VH of SEQ ID NO: 64 and the VL of SEQ ID NO: 57.

In some embodiments, the Fab comprises the VH of SEQ ID NO: 64 and the VL of SEQ ID NO: 59.

In some embodiments, the Fab comprises the VH of SEQ ID NO: 64 and the VL of SEQ ID NO: 61.

In some embodiments, the Fab comprises the VH of SEQ ID NO: 64 and the VL of SEQ ID NO: 63.

In some embodiments, the Fab comprises the VH of SEQ ID NO: 64 and the VL of SEQ ID NO: 65.

In some embodiments, the Fab comprises the VH of SEQ ID NO: 64 and the VL of SEQ ID NO: 67.

In some embodiments, the Fab comprises the VH of SEQ ID NO: 64 and the VL of SEQ ID NO: 69.

In some embodiments, the Fab comprises the VH of SEQ ID NO: 66 and the VL of SEQ ID NO: 51.

In some embodiments, the Fab comprises the VH of SEQ ID NO: 66 and the VL of SEQ ID NO: 53.

In some embodiments, the Fab comprises the VH of SEQ ID NO: 66 and the VL of SEQ ID NO: 55.

In some embodiments, the Fab comprises the VH of SEQ ID NO: 66 and the VL of SEQ ID NO: 57.

In some embodiments, the Fab comprises the VH of SEQ ID NO: 66 and the VL of SEQ ID NO: 59.

In some embodiments, the Fab comprises the VH of SEQ ID NO: 66 and the VL of SEQ ID NO: 61.

In some embodiments, the Fab comprises the VH of SEQ ID NO: 66 and the VL of SEQ ID NO: 63.

In some embodiments, the Fab comprises the VH of SEQ ID NO: 66 and the VL of SEQ ID NO: 65.

In some embodiments, the Fab comprises the VH of SEQ ID NO: 66 and the VL of SEQ ID NO: 67.

In some embodiments, the Fab comprises the VH of SEQ ID NO: 66 and the VL of SEQ ID NO: 69.

In some embodiments, the Fab comprises the VH of SEQ ID NO: 68 and the VL of SEQ ID NO: 51.

In some embodiments, the Fab comprises the VH of SEQ ID NO: 68 and the VL of SEQ ID NO: 53.

In some embodiments, the Fab comprises the VH of SEQ ID NO: 68 and the VL of SEQ ID NO: 55.

In some embodiments, the Fab comprises the VH of SEQ ID NO: 68 and the VL of SEQ ID NO: 57.

In some embodiments, the Fab comprises the VH of SEQ ID NO: 68 and the VL of SEQ ID NO: 59.

In some embodiments, the Fab comprises the VH of SEQ ID NO: 68 and the VL of SEQ ID NO: 61.

In some embodiments, the Fab comprises the VH of SEQ ID NO: 68 and the VL of SEQ ID NO: 63.

In some embodiments, the Fab comprises the VH of SEQ ID NO: 68 and the VL of SEQ ID NO: 65.

In some embodiments, the Fab comprises the VH of SEQ ID NO: 68 and the VL of SEQ ID NO: 67.

In some embodiments, the Fab comprises the VH of SEQ ID NO: 68 and the VL of SEQ ID NO: 69.

In some embodiments, the F(ab')$_2$ comprises
- a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or
- the HCDR1, the HCDR2 and the HCDR3 of the VH of SEQ ID NO: 52 and the LCDR1, the LCDR2 and the LCDR3 of the VL of SEQ ID NO: 53; or
- the HCDR1, the HCDR2 and the HCDR3 of the VH of SEQ ID NO: 54 and the LCDR1, the LCDR2 and the LCDR3 of the VL of SEQ ID NO: 55; or
- the HCDR1, the HCDR2 and the HCDR3 of the VH of SEQ ID NO: 56 and the LCDR1, the LCDR2 and the LCDR3 of the VL of SEQ ID NO: 57; or
- the HCDR1, the HCDR2 and the HCDR3 of the VH of SEQ ID NO: 58 and the LCDR1, the LCDR2 and the LCDR3 of the VL of SEQ ID NO: 59; or
- the HCDR1, the HCDR2 and the HCDR3 of the VH of SEQ ID NO: 60 and the LCDR1, the LCDR2 and the LCDR3 of the VL of SEQ ID NO: 61; or
- the HCDR1, the HCDR2 and the HCDR3 of the VH of SEQ ID NO: 62 and the LCDR1, the LCDR2 and the LCDR3 of the VL of SEQ ID NO: 63; or
- the HCDR1, the HCDR2 and the HCDR3 of the VH of SEQ ID NO: 64 and the LCDR1, the LCDR2 and the LCDR3 of the VL of SEQ ID NO: 65; or
- the HCDR1, the HCDR2 and the HCDR3 of the VH of SEQ ID NO: 66 and the LCDR1, the LCDR2 and the LCDR3 of the VL of SEQ ID NO: 67; or
- the HCDR1, the HCDR2 and the HCDR3 of the VH of SEQ ID NO: 68 and the LCDR1, the LCDR2 and the LCDR3 of the VL of SEQ ID NO: 69.

In some embodiments, the F(ab')$_2$ comprises the HCDR1, the HCDR2, the HCDR3, the LCDR1, the LCDR2 and the LCDR3 of
- SEQ ID NOs: 70, 71, 72, 88, 89, and 90, respectively;
- SEQ ID NOs: 73, 71, 74, 91, 89, and 92, respectively;
- SEQ ID NOs: 75, 76, 77, 93, 89, and 94, respectively;
- SEQ ID NOs: 78, 79, 80, 95, 89, and 96, respectively;
- SEQ ID NOs: 81, 82, 83, 97, 89, and 98, respectively;
- SEQ ID NOs: 78, 71, 84, 99, 89, and 100, respectively;
- SEQ ID NOs: 78, 71, 84, 101, 89, and 100, respectively;
- SEQ ID NOs: 85, 86, 87, 102, 103, and 104, respectively; or
- SEQ ID NOs: 78, 71, 84, 95, 89, and 96, respectively.

In some embodiments, the F(ab')₂ comprises the HCDR1, the HCDR2, the HCDR3, the LCDR1, the LCDR2 and the LCDR3 of SEQ ID NOs: 70, 71, 72, 88, 89, and 90, respectively.

In some embodiments, the F(ab')₂ comprises the HCDR1, the HCDR2, the HCDR3, the LCDR1, the LCDR2 and the LCDR3 of SEQ ID NOs: 73, 71, 74, 91, 89, and 92, respectively.

In some embodiments, the F(ab')₂ comprises the HCDR1, the HCDR2, the HCDR3, the LCDR1, the LCDR2 and the LCDR3 of SEQ ID NOs: 75, 76, 77, 93, 89, and 94, respectively.

In some embodiments, the F(ab')2 comprises the HCDR1, the HCDR2, the HCDR3, the LCDR1, the LCDR2 and the LCDR3 of SEQ ID NOs: 78, 79, 80, 95, 89, and 96, respectively.

In some embodiments, the F(ab')2 comprises the HCDR1, the HCDR2, the HCDR3, the LCDR1, the LCDR2 and the LCDR3 of SEQ ID Nos: 81, 82, 83, 97, 89, and 98, respectively.

In some embodiments, the F(ab')2 comprises the HCDR1, the HCDR2, the HCDR3, the LCDR1, the LCDR2 and the LCDR3 of SEQ ID NOs: 78, 71, 84, 99, 89, and 100, respectively.

In some embodiments, the F(ab')2 comprises the HCDR1, the HCDR2, the HCDR3, the LCDR1, the LCDR2 and the LCDR3 of SEQ ID NOs: 78, 71, 84, 101, 89, and 100, respectively.

In some embodiments, the F(ab')2 comprises the HCDR1, the HCDR2, the HCDR3, the LCDR1, the LCDR2 and the LCDR3 of SEQ ID NOs: 85, 86, 87, 102, 103, and 104, respectively.

In some embodiments, the F(ab')2 comprises the HCDR1, the HCDR2, the HCDR3, the LCDR1, the LCDR2 and the LCDR3 of SEQ ID NOs: 78, 71, 84, 95, 89, and 96, respectively.

In some embodiments, the F(ab')2 comprises the VH of SEQ ID NO: 50 and the VL of SEQ ID NO: 51.

In some embodiments, the F(ab')2 comprises the VH of SEQ ID NO: 52 and the VL of SEQ ID NO: 53.

In some embodiments, the F(ab')2 comprises the VH of SEQ ID NO: 54 and the VL of SEQ ID NO: 55.

In some embodiments, the F(ab')2 comprises the VH of SEQ ID NO: 56 and the VL of SEQ ID NO: 57.

In some embodiments, the F(ab')2 comprises the VH of SEQ ID NO: 58 and the VL of SEQ ID NO: 59.

In some embodiments, the F(ab')2 comprises the VH of SEQ ID NO: 60 and the VL of SEQ ID NO: 61.

In some embodiments, the F(ab')2 comprises the VH of SEQ ID NO: 62 and the VL of SEQ ID NO: 63.

In some embodiments, the F(ab')2 comprises the VH of SEQ ID NO: 64 and the VL of SEQ ID NO: 65.

In some embodiments, the F(ab')2 comprises the VH of SEQ ID NO: 66 and the VL of SEQ ID NO: 67.

In some embodiments, the F(ab')2 comprises the VH of SEQ ID NO: 68 and the VL of SEQ ID NO: 69.

In some embodiments, the F(ab')2 comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

In some embodiments, the F(ab')2 comprises the VH of SEQ ID NO: 50 and the VL of SEQ ID NO: 51.

In some embodiments, the F(ab')2 comprises the VH of SEQ ID NO: 50 and the VL of SEQ ID NO: 53.

In some embodiments, the F(ab')2 comprises the VH of SEQ ID NO: 50 and the VL of SEQ ID NO: 55.

In some embodiments, the F(ab')2 comprises the VH of SEQ ID NO: 50 and the VL of SEQ ID NO: 57.

In some embodiments, the F(ab')2 comprises the VH of SEQ ID NO: 50 and the VL of SEQ ID NO: 59.

In some embodiments, the F(ab')2 comprises the VH of SEQ ID NO: 50 and the VL of SEQ ID NO: 61.

In some embodiments, the F(ab')2 comprises the VH of SEQ ID NO: 50 and the VL of SEQ ID NO: 63.

In some embodiments, the F(ab')2 comprises the VH of SEQ ID NO: 50 and the VL of SEQ ID NO: 65.

In some embodiments, the F(ab')2 comprises the VH of SEQ ID NO: 50 and the VL of SEQ ID NO: 67.

In some embodiments, the F(ab')2 comprises the VH of SEQ ID NO: 50 and the VL of SEQ ID NO: 69.

In some embodiments, the F(ab')2 comprises the VH of SEQ ID NO: 52 and the VL of SEQ ID NO: 51.

In some embodiments, the F(ab')2 comprises the VH of SEQ ID NO: 52 and the VL of SEQ ID NO: 53.

In some embodiments, the F(ab')2 comprises the VH of SEQ ID NO: 52 and the VL of SEQ ID NO: 55.

In some embodiments, the F(ab')2 comprises the VH of SEQ ID NO: 52 and the VL of SEQ ID NO: 57.

In some embodiments, the F(ab')2 comprises the VH of SEQ ID NO: 52 and the VL of SEQ ID NO: 59.

In some embodiments, the F(ab')2 comprises the VH of SEQ ID NO: 52 and the VL of SEQ ID NO: 61.

In some embodiments, the F(ab')2 comprises the VH of SEQ ID NO: 52 and the VL of SEQ ID NO: 63.

In some embodiments, the F(ab')2 comprises the VH of SEQ ID NO: 52 and the VL of SEQ ID NO: 65.

In some embodiments, the F(ab')2 comprises the VH of SEQ ID NO: 52 and the VL of SEQ ID NO: 67.

In some embodiments, the F(ab')2 comprises the VH of SEQ ID NO: 52 and the VL of SEQ ID NO: 69.

In some embodiments, the F(ab')2 comprises the VH of SEQ ID NO: 54 and the VL of SEQ ID NO: 51.

In some embodiments, the F(ab')2 comprises the VH of SEQ ID NO: 54 and the VL of SEQ ID NO: 53.

In some embodiments, the F(ab')2 comprises the VH of SEQ ID NO: 54 and the VL of SEQ ID NO: 55.

In some embodiments, the F(ab')2 comprises the VH of SEQ ID NO: 54 and the VL of SEQ ID NO: 57.

In some embodiments, the F(ab')2 comprises the VH of SEQ ID NO: 54 and the VL of SEQ ID NO: 59.

In some embodiments, the F(ab')2 comprises the VH of SEQ ID NO: 54 and the VL of SEQ ID NO: 61.

In some embodiments, the F(ab')2 comprises the VH of SEQ ID NO: 54 and the VL of SEQ ID NO: 63.

In some embodiments, the F(ab')2 comprises the VH of SEQ ID NO: 54 and the VL of SEQ ID NO: 65.

In some embodiments, the F(ab')2 comprises the VH of SEQ ID NO: 54 and the VL of SEQ ID NO: 67.

In some embodiments, the F(ab')2 comprises the VH of SEQ ID NO: 54 and the VL of SEQ ID NO: 69.

In some embodiments, the F(ab')2 comprises the VH of SEQ ID NO: 56 and the VL of SEQ ID NO: 51.

In some embodiments, the F(ab')2 comprises the VH of SEQ ID NO: 56 and the VL of SEQ ID NO: 53.

In some embodiments, the F(ab')2 comprises the VH of SEQ ID NO: 56 and the VL of SEQ ID NO: 55.

In some embodiments, the F(ab')2 comprises the VH of SEQ ID NO: 56 and the VL of SEQ ID NO: 57.

In some embodiments, the F(ab')2 comprises the VH of SEQ ID NO: 56 and the VL of SEQ ID NO: 59.

In some embodiments, the F(ab')2 comprises the VH of SEQ ID NO: 56 and the VL of SEQ ID NO: 61.

In some embodiments, the F(ab')2 comprises the VH of SEQ ID NO: 56 and the VL of SEQ ID NO: 63.
In some embodiments, the F(ab')2 comprises the VH of SEQ ID NO: 56 and the VL of SEQ ID NO: 65.
In some embodiments, the F(ab')2 comprises the VH of SEQ ID NO: 56 and the VL of SEQ ID NO: 67.
In some embodiments, the F(ab')2 comprises the VH of SEQ ID NO: 56 and the VL of SEQ ID NO: 69.
In some embodiments, the F(ab')2 comprises the VH of SEQ ID NO: 58 and the VL of SEQ ID NO: 51.
In some embodiments, the F(ab')2 comprises the VH of SEQ ID NO: 58 and the VL of SEQ ID NO: 53.
In some embodiments, the F(ab')2 comprises the VH of SEQ ID NO: 58 and the VL of SEQ ID NO: 55.
In some embodiments, the F(ab')2 comprises the VH of SEQ ID NO: 58 and the VL of SEQ ID NO: 57.
In some embodiments, the F(ab')2 comprises the VH of SEQ ID NO: 58 and the VL of SEQ ID NO: 59.
In some embodiments, the F(ab')2 comprises the VH of SEQ ID NO: 58 and the VL of SEQ ID NO: 61.
In some embodiments, the F(ab')2 comprises the VH of SEQ ID NO: 58 and the VL of SEQ ID NO: 63.
In some embodiments, the F(ab')2 comprises the VH of SEQ ID NO: 58 and the VL of SEQ ID NO: 65.
In some embodiments, the F(ab')2 comprises the VH of SEQ ID NO: 58 and the VL of SEQ ID NO: 67.
In some embodiments, the F(ab')2 comprises the VH of SEQ ID NO: 58 and the VL of SEQ ID NO: 69.
In some embodiments, the F(ab')2 comprises the VH of SEQ ID NO: 60 and the VL of SEQ ID NO: 51.
In some embodiments, the F(ab')2 comprises the VH of SEQ ID NO: 60 and the VL of SEQ ID NO:
In some embodiments, the F(ab')2 comprises the VH of SEQ ID NO: 60 and the VL of SEQ ID NO: 55.
In some embodiments, the F(ab')2 comprises the VH of SEQ ID NO: 60 and the VL of SEQ ID NO: 57.
In some embodiments, the F(ab')2 comprises the VH of SEQ ID NO: 60 and the VL of SEQ ID NO: 59.
In some embodiments, the F(ab')2 comprises the VH of SEQ ID NO: 60 and the VL of SEQ ID NO: 61.
In some embodiments, the F(ab')2 comprises the VH of SEQ ID NO: 60 and the VL of SEQ ID NO: 63.
In some embodiments, the F(ab')2 comprises the VH of SEQ ID NO: 60 and the VL of SEQ ID NO: 65.
In some embodiments, the F(ab')2 comprises the VH of SEQ ID NO: 60 and the VL of SEQ ID NO: 67.
In some embodiments, the F(ab')2 comprises the VH of SEQ ID NO: 60 and the VL of SEQ ID NO: 69.
In some embodiments, the F(ab')2 comprises the VH of SEQ ID NO: 62 and the VL of SEQ ID NO: 51.
In some embodiments, the F(ab')2 comprises the VH of SEQ ID NO: 62 and the VL of SEQ ID NO: 53.
In some embodiments, the F(ab')2 comprises the VH of SEQ ID NO: 62 and the VL of SEQ ID NO: 55.
In some embodiments, the F(ab')2 comprises the VH of SEQ ID NO: 62 and the VL of SEQ ID NO: 57.
In some embodiments, the F(ab')2 comprises the VH of SEQ ID NO: 62 and the VL of SEQ ID NO: 59.
In some embodiments, the F(ab')2 comprises the VH of SEQ ID NO: 62 and the VL of SEQ ID NO: 61.
In some embodiments, the F(ab')2 comprises the VH of SEQ ID NO: 62 and the VL of SEQ ID NO: 63.
In some embodiments, the F(ab')2 comprises the VH of SEQ ID NO: 62 and the VL of SEQ ID NO: 65.
In some embodiments, the F(ab')2 comprises the VH of SEQ ID NO: 62 and the VL of SEQ ID NO: 67.
In some embodiments, the F(ab')2 comprises the VH of SEQ ID NO: 62 and the VL of SEQ ID NO: 69.
In some embodiments, the F(ab')2 comprises the VH of SEQ ID NO: 64 and the VL of SEQ ID NO: 51.
In some embodiments, the F(ab')2 comprises the VH of SEQ ID NO: 64 and the VL of SEQ ID NO: 53.
In some embodiments, the F(ab')2 comprises the VH of SEQ ID NO: 64 and the VL of SEQ ID NO: 55.
In some embodiments, the F(ab')2 comprises the VH of SEQ ID NO: 64 and the VL of SEQ ID NO: 57.
In some embodiments, the F(ab')2 comprises the VH of SEQ ID NO: 64 and the VL of SEQ ID NO: 59.
In some embodiments, the F(ab')2 comprises the VH of SEQ ID NO: 64 and the VL of SEQ ID NO: 61.
In some embodiments, the F(ab')2 comprises the VH of SEQ ID NO: 64 and the VL of SEQ ID NO: 63.
In some embodiments, the F(ab')2 comprises the VH of SEQ ID NO: 64 and the VL of SEQ ID NO: 65.
In some embodiments, the F(ab')2 comprises the VH of SEQ ID NO: 64 and the VL of SEQ ID NO: 67.
In some embodiments, the F(ab')2 comprises the VH of SEQ ID NO: 64 and the VL of SEQ ID NO: 69.
In some embodiments, the F(ab')2 comprises the VH of SEQ ID NO: 66 and the VL of SEQ ID NO: 51.
In some embodiments, the F(ab')2 comprises the VH of SEQ ID NO: 66 and the VL of SEQ ID NO: 53.
In some embodiments, the F(ab')2 comprises the VH of SEQ ID NO: 66 and the VL of SEQ ID NO: 55.
In some embodiments, the F(ab')2 comprises the VH of SEQ ID NO: 66 and the VL of SEQ ID NO: 57.
In some embodiments, the F(ab')2 comprises the VH of SEQ ID NO: 66 and the VL of SEQ ID NO: 59.
In some embodiments, the F(ab')2 comprises the VH of SEQ ID NO: 66 and the VL of SEQ ID NO: 61.
In some embodiments, the F(ab')2 comprises the VH of SEQ ID NO: 66 and the VL of SEQ ID NO: 63.
In some embodiments, the F(ab')2 comprises the VH of SEQ ID NO: 66 and the VL of SEQ ID NO: 65.
In some embodiments, the F(ab')2 comprises the VH of SEQ ID NO: 66 and the VL of SEQ ID NO: 67.
In some embodiments, the F(ab')2 comprises the VH of SEQ ID NO: 66 and the VL of SEQ ID NO: 69.
In some embodiments, the F(ab')2 comprises the VH of SEQ ID NO: 68 and the VL of SEQ ID NO: 51.
In some embodiments, the F(ab')2 comprises the VH of SEQ ID NO: 68 and the VL of SEQ ID NO: 53.
In some embodiments, the F(ab')2 comprises the VH of SEQ ID NO: 68 and the VL of SEQ ID NO: 55.
In some embodiments, the F(ab')2 comprises the VH of SEQ ID NO: 68 and the VL of SEQ ID NO: 57.
In some embodiments, the F(ab')2 comprises the VH of SEQ ID NO: 68 and the VL of SEQ ID NO: 59.
In some embodiments, the F(ab')2 comprises the VH of SEQ ID NO: 68 and the VL of SEQ ID NO: 61.
In some embodiments, the F(ab')2 comprises the VH of SEQ ID NO: 68 and the VL of SEQ ID NO: 63.
In some embodiments, the F(ab')2 comprises the VH of SEQ ID NO: 68 and the VL of SEQ ID NO: 65.
In some embodiments, the F(ab')2 comprises the VH of SEQ ID NO: 68 and the VL of SEQ ID NO: 67.
In some embodiments, the F(ab')2 comprises the VH of SEQ ID NO: 68 and the VL of SEQ ID NO: 69.
In some embodiments, the Fv comprises
a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or the HCDR1, the HCDR2 and the HCDR3 of the VH of SEQ ID NO: 52 and the LCDR1, the LCDR2 and the LCDR3 of the VL of SEQ ID NO: 53; or the HCDR1, the HCDR2 and the HCDR3 of the VH of SEQ ID NO: 54 and the LCDR1, the LCDR2 and the LCDR3 of the VL of SEQ ID NO: 55; or the HCDR1, the HCDR2 and the HCDR3 of the VH of SEQ ID NO: 56 and the LCDR1, the LCDR2 and the LCDR3 of the VL of SEQ ID NO: 57; or the HCDR1, the HCDR2 and the HCDR3 of the VH of SEQ ID NO: 58 and the LCDR1, the LCDR2 and the LCDR3 of the VL of SEQ ID NO: 59; or the HCDR1, the HCDR2 and the HCDR3 of the VH of SEQ ID NO: 60 and the LCDR1, the LCDR2 and the LCDR3 of the VL of SEQ ID NO: 61; or the HCDR1, the HCDR2 and the HCDR3 of the VH of SEQ ID NO: 62 and the LCDR1, the LCDR2 and the LCDR3 of the VL of SEQ ID NO: 63; or the HCDR1, the HCDR2 and the HCDR3 of the VH of SEQ ID NO: 64 and the LCDR1, the LCDR2 and the LCDR3 of the VL of SEQ ID NO: 65; or the HCDR1, the HCDR2 and the HCDR3 of the VH of SEQ ID NO: 66 and the LCDR1, the LCDR2 and the LCDR3 of the VL of SEQ ID NO: 67; or the HCDR1, the HCDR2 and the HCDR3 of the VH of SEQ ID NO: 68 and the LCDR1, the LCDR2 and the LCDR3 of the VL of SEQ ID NO: 69.

In some embodiments, the Fv comprises the HCDR1, the HCDR2, the HCDR3, the LCDR1, the LCDR2 and the LCDR3 of SEQ ID NOs: 70, 71, 72, 88, 89, and 90, respectively;
SEQ ID NOs: 73, 71, 74, 91, 89, and 92, respectively;
SEQ ID NOs: 75, 76, 77, 93, 89, and 94, respectively;
SEQ ID NOs: 78, 79, 80, 95, 89, and 96, respectively;
SEQ ID NOs: 81, 82, 83, 97, 89, and 98, respectively;
SEQ ID NOs: 78, 71, 84, 99, 89, and 100, respectively;
SEQ ID NOs: 78, 71, 84, 101, 89, and 100, respectively;
SEQ ID NOs: 85, 86, 87, 102, 103, and 104, respectively; or
SEQ ID NOs: 78, 71, 84, 95, 89, and 96, respectively.

In some embodiments, the Fv comprises the HCDR1, the HCDR2, the HCDR3, the LCDR1, the LCDR2 and the LCDR3 of SEQ ID NOs: 70, 71, 72, 88, 89, and 90, respectively.

In some embodiments, the Fv comprises the HCDR1, the HCDR2, the HCDR3, the LCDR1, the LCDR2 and the LCDR3 of SEQ ID NOs: 73, 71, 74, 91, 89, and 92, respectively.

In some embodiments, the Fv comprises the HCDR1, the HCDR2, the HCDR3, the LCDR1, the LCDR2 and the LCDR3 of SEQ ID NOs: 75, 76, 77, 93, 89, and 94, respectively.

In some embodiments, the Fv comprises the HCDR1, the HCDR2, the HCDR3, the LCDR1, the LCDR2 and the LCDR3 of SEQ ID NOs: 78, 79, 80, 95, 89, and 96, respectively.

In some embodiments, the Fv comprises the HCDR1, the HCDR2, the HCDR3, the LCDR1, the LCDR2 and the LCDR3 of SEQ ID Nos: 81, 82, 83, 97, 89, and 98, respectively.

In some embodiments, the Fv comprises the HCDR1, the HCDR2, the HCDR3, the LCDR1, the LCDR2 and the LCDR3 of SEQ ID NOs: 78, 71, 84, 99, 89, and 100, respectively.

In some embodiments, the Fv comprises the HCDR1, the HCDR2, the HCDR3, the LCDR1, the LCDR2 and the LCDR3 of SEQ ID NOs: 78, 71, 84, 101, 89, and 100, respectively.

In some embodiments, the Fv comprises the HCDR1, the HCDR2, the HCDR3, the LCDR1, the LCDR2 and the LCDR3 of SEQ ID NOs: 85, 86, 87, 102, 103, and 104, respectively.

In some embodiments, the Fv comprises the HCDR1, the HCDR2, the HCDR3, the LCDR1, the LCDR2 and the LCDR3 of SEQ ID NOs: 78, 71, 84, 95, 89, and 96, respectively.

In some embodiments, the Fv comprises the VH of SEQ ID NO: 50 and the VL of SEQ ID NO: 51.

In some embodiments, the Fv comprises the VH of SEQ ID NO: 52 and the VL of SEQ ID NO: 53.

In some embodiments, the Fv comprises the VH of SEQ ID NO: 54 and the VL of SEQ ID NO: 55.

In some embodiments, the Fv comprises the VH of SEQ ID NO: 56 and the VL of SEQ ID NO: 57.

In some embodiments, the Fv comprises the VH of SEQ ID NO: 58 and the VL of SEQ ID NO: 59.

In some embodiments, the Fv comprises the VH of SEQ ID NO: 60 and the VL of SEQ ID NO: 61.

In some embodiments, the Fv comprises the VH of SEQ ID NO: 62 and the VL of SEQ ID NO: 63.

In some embodiments, the Fv comprises the VH of SEQ ID NO: 64 and the VL of SEQ ID NO: 65.

In some embodiments, the Fv comprises the VH of SEQ ID NO: 66 and the VL of SEQ ID NO:

In some embodiments, the Fv comprises the VH of SEQ ID NO: 68 and the VL of SEQ ID NO: 69.

In some embodiments, the Fv comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

In some embodiments, the Fv comprises the VH of SEQ ID NO: 50 and the VL of SEQ ID NO: 51.

In some embodiments, the Fv comprises the VH of SEQ ID NO: 50 and the VL of SEQ ID NO: 53.

In some embodiments, the Fv comprises the VH of SEQ ID NO: 50 and the VL of SEQ ID NO: 55.

In some embodiments, the Fv comprises the VH of SEQ ID NO: 50 and the VL of SEQ ID NO: 57.

In some embodiments, the Fv comprises the VH of SEQ ID NO: 50 and the VL of SEQ ID NO: 59.

In some embodiments, the Fv comprises the VH of SEQ ID NO: 50 and the VL of SEQ ID NO: 61.

In some embodiments, the Fv comprises the VH of SEQ ID NO: 50 and the VL of SEQ ID NO: 63.

In some embodiments, the Fv comprises the VH of SEQ ID NO: 50 and the VL of SEQ ID NO: 65.

In some embodiments, the Fv comprises the VH of SEQ ID NO: 50 and the VL of SEQ ID NO: 67.

In some embodiments, the Fv comprises the VH of SEQ ID NO: 50 and the VL of SEQ ID NO: 69.

In some embodiments, the Fv comprises the VH of SEQ ID NO: 52 and the VL of SEQ ID NO: 51.

In some embodiments, the Fv comprises the VH of SEQ ID NO: 52 and the VL of SEQ ID NO: 53.

In some embodiments, the Fv comprises the VH of SEQ ID NO: 52 and the VL of SEQ ID NO: 55.

In some embodiments, the Fv comprises the VH of SEQ ID NO: 52 and the VL of SEQ ID NO: 57.

In some embodiments, the Fv comprises the VH of SEQ ID NO: 52 and the VL of SEQ ID NO: 59.

In some embodiments, the Fv comprises the VH of SEQ ID NO: 52 and the VL of SEQ ID NO: 61.

In some embodiments, the Fv comprises the VH of SEQ ID NO: 52 and the VL of SEQ ID NO: 63.
In some embodiments, the Fv comprises the VH of SEQ ID NO: 52 and the VL of SEQ ID NO: 65.
In some embodiments, the Fv comprises the VH of SEQ ID NO: 52 and the VL of SEQ ID NO: 67.
In some embodiments, the Fv comprises the VH of SEQ ID NO: 52 and the VL of SEQ ID NO: 69.
In some embodiments, the Fv comprises the VH of SEQ ID NO: 54 and the VL of SEQ ID NO: 51.
In some embodiments, the Fv comprises the VH of SEQ ID NO: 54 and the VL of SEQ ID NO: 53.
In some embodiments, the Fv comprises the VH of SEQ ID NO: 54 and the VL of SEQ ID NO: 55.
In some embodiments, the Fv comprises the VH of SEQ ID NO: 54 and the VL of SEQ ID NO: 57.
In some embodiments, the Fv comprises the VH of SEQ ID NO: 54 and the VL of SEQ ID NO: 59.
In some embodiments, the Fv comprises the VH of SEQ ID NO: 54 and the VL of SEQ ID NO: 61.
In some embodiments, the Fv comprises the VH of SEQ ID NO: 54 and the VL of SEQ ID NO: 63.
In some embodiments, the Fv comprises the VH of SEQ ID NO: 54 and the VL of SEQ ID NO: 65.
In some embodiments, the Fv comprises the VH of SEQ ID NO: 54 and the VL of SEQ ID NO: 67.
In some embodiments, the Fv comprises the VH of SEQ ID NO: 54 and the VL of SEQ ID NO: 69.
In some embodiments, the Fv comprises the VH of SEQ ID NO: 56 and the VL of SEQ ID NO: 51.
In some embodiments, the Fv comprises the VH of SEQ ID NO: 56 and the VL of SEQ ID NO: 53.
In some embodiments, the Fv comprises the VH of SEQ ID NO: 56 and the VL of SEQ ID NO: 55.
In some embodiments, the Fv comprises the VH of SEQ ID NO: 56 and the VL of SEQ ID NO: 57.
In some embodiments, the Fv comprises the VH of SEQ ID NO: 56 and the VL of SEQ ID NO: 59.
In some embodiments, the Fv comprises the VH of SEQ ID NO: 56 and the VL of SEQ ID NO: 61.
In some embodiments, the Fv comprises the VH of SEQ ID NO: 56 and the VL of SEQ ID NO: 63.
In some embodiments, the Fv comprises the VH of SEQ ID NO: 56 and the VL of SEQ ID NO: 65.
In some embodiments, the Fv comprises the VH of SEQ ID NO: 56 and the VL of SEQ ID NO: 67.
In some embodiments, the Fv comprises the VH of SEQ ID NO: 56 and the VL of SEQ ID NO: 69.
In some embodiments, the Fv comprises the VH of SEQ ID NO: 58 and the VL of SEQ ID NO: 51.
In some embodiments, the Fv comprises the VH of SEQ ID NO: 58 and the VL of SEQ ID NO: 53.
In some embodiments, the Fv comprises the VH of SEQ ID NO: 58 and the VL of SEQ ID NO: 55.
In some embodiments, the Fv comprises the VH of SEQ ID NO: 58 and the VL of SEQ ID NO: 57.
In some embodiments, the Fv comprises the VH of SEQ ID NO: 58 and the VL of SEQ ID NO: 59.
In some embodiments, the Fv comprises the VH of SEQ ID NO: 58 and the VL of SEQ ID NO: 61.
In some embodiments, the Fv comprises the VH of SEQ ID NO: 58 and the VL of SEQ ID NO: 63.
In some embodiments, the Fv comprises the VH of SEQ ID NO: 58 and the VL of SEQ ID NO: 65.
In some embodiments, the Fv comprises the VH of SEQ ID NO: 58 and the VL of SEQ ID NO: 67.
In some embodiments, the Fv comprises the VH of SEQ ID NO: 58 and the VL of SEQ ID NO: 69.
In some embodiments, the Fv comprises the VH of SEQ ID NO: 60 and the VL of SEQ ID NO: 51.
In some embodiments, the Fv comprises the VH of SEQ ID NO: 60 and the VL of SEQ ID NO: 53.
In some embodiments, the Fv comprises the VH of SEQ ID NO: 60 and the VL of SEQ ID NO: 55.
In some embodiments, the Fv comprises the VH of SEQ ID NO: 60 and the VL of SEQ ID NO: 57.
In some embodiments, the Fv comprises the VH of SEQ ID NO: 60 and the VL of SEQ ID NO: 59.
In some embodiments, the Fv comprises the VH of SEQ ID NO: 60 and the VL of SEQ ID NO: 61.
In some embodiments, the Fv comprises the VH of SEQ ID NO: 60 and the VL of SEQ ID NO: 63.
In some embodiments, the Fv comprises the VH of SEQ ID NO: 60 and the VL of SEQ ID NO: 65.
In some embodiments, the Fv comprises the VH of SEQ ID NO: 60 and the VL of SEQ ID NO: 67.
In some embodiments, the Fv comprises the VH of SEQ ID NO: 60 and the VL of SEQ ID NO: 69.
In some embodiments, the Fv comprises the VH of SEQ ID NO: 62 and the VL of SEQ ID NO: 51.
In some embodiments, the Fv comprises the VH of SEQ ID NO: 62 and the VL of SEQ ID NO: 53.
In some embodiments, the Fv comprises the VH of SEQ ID NO: 62 and the VL of SEQ ID NO: 55.
In some embodiments, the Fv comprises the VH of SEQ ID NO: 62 and the VL of SEQ ID NO: 57.
In some embodiments, the Fv comprises the VH of SEQ ID NO: 62 and the VL of SEQ ID NO: 59.
In some embodiments, the Fv comprises the VH of SEQ ID NO: 62 and the VL of SEQ ID NO: 61.
In some embodiments, the Fv comprises the VH of SEQ ID NO: 62 and the VL of SEQ ID NO: 63.
In some embodiments, the Fv comprises the VH of SEQ ID NO: 62 and the VL of SEQ ID NO: 65.
In some embodiments, the Fv comprises the VH of SEQ ID NO: 62 and the VL of SEQ ID NO: 67.
In some embodiments, the Fv comprises the VH of SEQ ID NO: 62 and the VL of SEQ ID NO: 69.
In some embodiments, the Fv comprises the VH of SEQ ID NO: 64 and the VL of SEQ ID NO: 51.
In some embodiments, the Fv comprises the VH of SEQ ID NO: 64 and the VL of SEQ ID NO: 53.
In some embodiments, the Fv comprises the VH of SEQ ID NO: 64 and the VL of SEQ ID NO: 55.
In some embodiments, the Fv comprises the VH of SEQ ID NO: 64 and the VL of SEQ ID NO: 57.
In some embodiments, the Fv comprises the VH of SEQ ID NO: 64 and the VL of SEQ ID NO: 59.
In some embodiments, the Fv comprises the VH of SEQ ID NO: 64 and the VL of SEQ ID NO: 61.
In some embodiments, the Fv comprises the VH of SEQ ID NO: 64 and the VL of SEQ ID NO: 63.
In some embodiments, the Fv comprises the VH of SEQ ID NO: 64 and the VL of SEQ ID NO: 65.
In some embodiments, the Fv comprises the VH of SEQ ID NO: 64 and the VL of SEQ ID NO: 67.
In some embodiments, the Fv comprises the VH of SEQ ID NO: 64 and the VL of SEQ ID NO: 69.
In some embodiments, the Fv comprises the VH of SEQ ID NO: 66 and the VL of SEQ ID NO: 51.
In some embodiments, the Fv comprises the VH of SEQ ID NO: 66 and the VL of SEQ ID NO: 53.

In some embodiments, the Fv comprises the VH of SEQ ID NO: 66 and the VL of SEQ ID NO: 55.
In some embodiments, the Fv comprises the VH of SEQ ID NO: 66 and the VL of SEQ ID NO: 57.
In some embodiments, the Fv comprises the VH of SEQ ID NO: 66 and the VL of SEQ ID NO: 59.
In some embodiments, the Fv comprises the VH of SEQ ID NO: 66 and the VL of SEQ ID NO: 61.
In some embodiments, the Fv comprises the VH of SEQ ID NO: 66 and the VL of SEQ ID NO: 63.
In some embodiments, the Fv comprises the VH of SEQ ID NO: 66 and the VL of SEQ ID NO: 65.
In some embodiments, the Fv comprises the VH of SEQ ID NO: 66 and the VL of SEQ ID NO: 67.
In some embodiments, the Fv comprises the VH of SEQ ID NO: 66 and the VL of SEQ ID NO: 69.
In some embodiments, the Fv comprises the VH of SEQ ID NO: 68 and the VL of SEQ ID NO: 51.
In some embodiments, the Fv comprises the VH of SEQ ID NO: 68 and the VL of SEQ ID NO: 53.
In some embodiments, the Fv comprises the VH of SEQ ID NO: 68 and the VL of SEQ ID NO: 55.
In some embodiments, the Fv comprises the VH of SEQ ID NO: 68 and the VL of SEQ ID NO: 57.
In some embodiments, the Fv comprises the VH of SEQ ID NO: 68 and the VL of SEQ ID NO: 59.
In some embodiments, the Fv comprises the VH of SEQ ID NO: 68 and the VL of SEQ ID NO: 61.
In some embodiments, the Fv comprises the VH of SEQ ID NO: 68 and the VL of SEQ ID NO: 63.
In some embodiments, the Fv comprises the VH of SEQ ID NO: 68 and the VL of SEQ ID NO: 65.
In some embodiments, the Fv comprises the VH of SEQ ID NO: 68 and the VL of SEQ ID NO: 67.
In some embodiments, the Fv comprises the VH of SEQ ID NO: 68 and the VL of SEQ ID NO: 69.
In some embodiments, the Fd comprises the VH of SEQ ID NO: 50.
In some embodiments, the Fd comprises the VH of SEQ ID NO: 52.
In some embodiments, the Fd comprises the VH of SEQ ID NO: 54.
In some embodiments, the Fd comprises the VH of SEQ ID NO: 56.
In some embodiments, the Fd comprises the VH of SEQ ID NO: 58.
In some embodiments, the Fd comprises the VH of SEQ ID NO: 60.
In some embodiments, the Fd comprises the VH of SEQ ID NO: 62.
In some embodiments, the Fd comprises the VH of SEQ ID NO: 64.
In some embodiments, the Fd comprises the VH of SEQ ID NO: 66.
In some embodiments, the Fd comprises the VH of SEQ ID NO: 68.

Homologous Antigen Binding Domains and Antigen Binding Domains with Conservative Substitutions Variants of the antigen binding domains that bind HLA-G are within the scope of the disclosure. For example, variants may comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions in the antigen binding domain that bind HLA-G as long as they retain or have improved functional properties when compared to the parent antigen binding domains. In some embodiments, the sequence identity may be about 80%, 81%, 82%, 83%, 84%, 85%, 86%, 87%, 88%, 89%, 90%, 91%, 92%, 93%, 94%, 95%, 96%, 97%, 98% or 99% to the antigen binding domains that bind HLA-G of the disclosure. In some embodiments, the variation is in the framework regions. In some embodiments, variants are generated by conservative substitutions.

For example, the antigen binding domains that bind HLA-G may comprise substitutions at residue positions of E1Q, L5Q, E6Q, S71P, E1Q, L5Q, E6Q, and S71P in the VH (residue numbering according to the MHGB688-VH of SEQ ID NO: 52) and K30E and G66V in the VL (residue numbering according to the MHGB688-VL of SEQ ID NO: 53). Conservative substitutions may be made at any indicated positions and the resulting variant antigen binding domains that bind HLA-G are tested for their desired characteristics in the assays described herein.

Also provided are antigen binding domains that bind HLA-G comprising the VH and the VL which are at least 80% identical to
the VH of SEQ ID NO: 50 and the VL of SEQ ID NO: 51;
the VH of SEQ ID NO: 52 and the VL of SEQ ID NO: 53;
the VH of SEQ ID NO: 54 and the VL of SEQ ID NO: 55;
the VH of SEQ ID NO: 56 and the VL of SEQ ID NO: 57;
the VH of SEQ ID NO: 58 and the VL of SEQ ID NO: 59;
the VH of SEQ ID NO: 60 and the VL of SEQ ID NO: 61;
the VH of SEQ ID NO: 62 and the VL of SEQ ID NO: 63;
the VH of SEQ ID NO: 64 and the VL of SEQ ID NO: 65;
the VH of SEQ ID NO: 66 and the VL of SEQ ID NO: 67;
or
the VH of SEQ ID NO: 68 and the VL of SEQ ID NO: 69.

In some embodiments, the identity is 85%. In some embodiments, the identity is 90%. In some embodiments, the identity is 91%. In some embodiments, the identity is 91%. In some embodiments, the identity is 92%. In some embodiments, the identity is 93%. In some embodiments, the identity is 94%.

In some embodiments, the identity is 94%. In some embodiments, the identity is 95%. In some embodiments, the identity is 96%. In some embodiments, the identity is 97%. In some embodiments, the identity is 98%. In some embodiments, the identity is 99%.

The percent identity between the two sequences is a function of the number of identical positions shared by the sequences (i.e., % identity=number of identical positions/total number of positions ×100), taking into account the number of gaps, and the length of each gap, which need to be introduced for optimal alignment of the two sequences.

The percent identity between two amino acid sequences may be determined using the algorithm of E. Meyers and W. Miller (*Comput Appl Biosci* 4:11-17 (1988)) which has been incorporated into the ALIGN program (version 2.0), using a PAM120 weight residue table, a gap length penalty of 12 and a gap penalty of 4. In addition, the percent identity between two amino acid sequences may be determined using the Needleman and Wunsch (*J Mol Biol* 48:444-453 (1970)) algorithm which has been incorporated into the GAP program in the GCG software package (available at http_//_www_gcg_com), using either a Blossum 62 matrix or a PAM250 matrix, and a gap weight of 16, 14, 12, 10, 8, 6, or 4 and a length weight of 1, 2, 3, 4, 5, or 6.

In some embodiments, variant antigen binding domains that bind HLA-G comprise one or two conservative substitutions in any of the CDR regions, while retaining desired functional properties of the parent antigen binding fragments that bind HLA-G.

"Conservative modifications" refer to amino acid modifications that do not significantly affect or alter the binding characteristics of the antibody containing the amino acid modifications. Conservative modifications include amino acid substitutions, additions and deletions. Conservative amino acid substitutions are those in which the amino acid is replaced with an amino acid residue having a similar side chain. The families of amino acid residues having similar side chains are well defined and include amino acids with acidic side chains (e.g., aspartic acid, glutamic acid), basic side chains (e.g., lysine, arginine, histidine), nonpolar side chains (e.g., alanine, valine, leucine, isoleucine, proline, phenylalanine, methionine), uncharged polar side chains (e.g., glycine, asparagine, glutamine, cysteine, serine, threonine, tyrosine, tryptophan), aromatic side chains (e.g., phenylalanine, tryptophan, histidine, tyrosine), aliphatic side chains (e.g., glycine, alanine, valine, leucine, isoleucine, serine, threonine), amide (e.g., asparagine, glutamine), beta-branched side chains (e.g., threonine, valine, isoleucine) and sulfur-containing side chains (cysteine, methionine). Furthermore, any native residue in the polypeptide may also be substituted with alanine, as has been previously described for alanine scanning mutagenesis (MacLennan et al., (1988) *Acta Physiol Scand* Suppl 643:55-67; Sasaki et al., (1988) *Adv Biophys* 35:1-24). Amino acid substitutions to the antibodies of the invention may be made by known methods for example by PCR mutagenesis (U.S. Pat. No. 4,683,195). Alternatively, libraries of variants may be generated for example using random (NNK) or non-random codons, for example DVK codons, which encode 11 amino acids (Ala, Cys, Asp, Glu, Gly, Lys, Asn, Arg, Ser, Tyr, Trp). The resulting variants may be tested for their characteristics using assays described herein.

Methods of Generating Antigen Binding Fragment that Bind HLA-G

Antigen binding domains that bind HLA-G provided in the disclosure may be generated using various technologies. For example, the hybridoma method of Kohler and Milstein may be used to identify VH/VL pairs that bind HLA-G. In the hybridoma method, a mouse or other host animal, such as a hamster, rat or chicken is immunized with human and/or cyno HLA-G, followed by fusion of spleen cells from immunized animals with myeloma cells using standard methods to form hybridoma cells. Colonies arising from single immortalized hybridoma cells may be screened for production of the antibodies containing the antigen binding domains that bind HLA-G with desired properties, such as specificity of binding, cross-reactivity or lack thereof, affinity for the antigen, and any desired functionality.

Antigen binding domains that bind HLA-G generated by immunizing non-human animals may be humanized. Exemplary humanization techniques including selection of human acceptor frameworks include CDR grafting (U.S. Pat. No. 5,225,539), SDR grafting (U.S. Pat. No. 6,818,749), Resurfacing (Padlan, (1991) *Mol Immunol* 28:489-499), Specificity Determining Residues Resurfacing (U.S. Patent Publ. No. 2010/0261620), human framework adaptation (U.S. Pat. No. 8,748,356) or superhumanization (U.S. Pat. No. 7,709, 226). In these methods, CDRs or a subset of CDR residues of parental antibodies are transferred onto human frameworks that may be selected based on their overall homology to the parental frameworks, based on similarity in CDR length, or canonical structure identity, or a combination thereof.

Humanized antigen binding domains may be further optimized to improve their selectivity or affinity to a desired antigen by incorporating altered framework support residues to preserve binding affinity (backmutations) by techniques such as those described in Int. Patent Publ. Nos. WO1090/ 007861 and WO1992/22653, or by introducing variation at any of the CDRs for example to improve affinity of the antigen binding domain.

Transgenic animals, such as mice, rat or chicken carrying human immunoglobulin (Ig) loci in their genome may be used to generate antigen binding fragments that bind HLA-G, and are described in for example U.S. Pat. No. 6,150,584, Int. Patent Publ. No. WO1999/45962, Int. Patent Publ. Nos. WO2002/066630, WO2002/43478, WO2002/043478 and WO1990/04036. The endogenous immunoglobulin loci in such animal may be disrupted or deleted, and at least one complete or partial human immunoglobulin locus may be inserted into the genome of the animal using homologous or non-homologous recombination, using transchromosomes, or using minigenes. Companies such as Regeneron (http://_www_regeneron_com), Harbour Antibodies (http://_www_harbourantibodies_com), Open Monoclonal Technology, Inc. (OMT) (http://_www_omtinc_net), KyMab (http://_www_kymab_com), Trianni (http://_www.trianni_com) and Ablexis (http://_www_ablexis_com) may be engaged to provide human antibodies directed against a selected antigen using technologies as described above.

Antigen binding domains that bind HLA-G may be selected from a phage display library, where the phage is engineered to express human immunoglobulins or portions thereof such as Fabs, single chain antibodies (scFv), or unpaired or paired antibody variable regions. The antigen binding domains that bind HLA-G may be isolated for example from phage display library expressing antibody heavy and light chain variable regions as fusion proteins with bacteriophage pIX coat protein as described in Shi et al., (2010) *J Mol Biol* 397:385-96, and Int. Patent Publ. No. WO09/085462). The libraries may be screened for phage binding to human and/or cyno HLA-G and the obtained positive clones may be further characterized, the Fabs isolated from the clone lysates, and converted to scFvs or other configurations of antigen binding fragments.

Preparation of immunogenic antigens and expression and production of antigen binding domains of the disclosure may be performed using any suitable technique, such as recombinant protein production. The immunogenic antigens may be administered to an animal in the form of purified protein, or protein mixtures including whole cells or cell or tissue extracts, or the antigen may be formed de novo in the animal's body from nucleic acids encoding said antigen or a portion thereof.

Conjugation to Half-Life Extending Moieties

The antigen binding domains that bind HLA-G of the disclosure may be conjugated to a half-life extending moiety. Exemplary half-life extending moieties are albumin, albumin variants, albumin-binding proteins and/or domains, transferrin and fragments and analogues thereof, immunoglobulins (Ig) or fragments thereof, such as Fc regions. Amino acid sequences of the aforementioned half-life extending moieties are known. Ig or fragments thereof include all isotypes, i.e., IgG1, IgG2, IgG3, IgG4, IgM, IgA and IgE.

Additional half-life extending moieties that may be conjugated to the antigen binding domains that bind HLA-G of the disclosure include polyethylene glycol (PEG) molecules, such as PEG5000 or PEG20,000, fatty acids and fatty acid esters of different chain lengths, for example laurate, myristate, stearate, arachidate, behenate, oleate, arachidonate, octanedioic acid, tetradecanedioic acid, octadecanedioic acid, docosanedioic acid, and the like, polylysine, octane, carbohydrates (dextran, cellulose, oligo- or polysaccharides) for desired properties. These moieties may be direct fusions with the antigen binding domains that bind HLA-G of the disclosure and may be generated by standard cloning and expression techniques. Alternatively, well known chemical coupling methods may be used to attach the moieties to recombinantly produced antigen binding domains that bind HLA-G of the disclosure.

A pegyl moiety may for example be conjugated to the antigen binding domain that bind HLA-G of the disclosure by incorporating a cysteine residue to the C-terminus of the antigen binding domain that bind HLA-G of the disclosure, or engineering cysteines into residue positions that face away from the HLA-G binding site and attaching a pegyl group to the cysteine using well known methods.

In some embodiments, the antigen binding fragment that binds HLA-G is conjugated to a half-life extending moiety.

In some embodiments, the half-life extending moiety is an immunoglobulin (Ig), a fragment of the Ig, an Ig constant region, a fragment of the Ig constant region, a Fc region, transferrin, albumin, an albumin binding domain or polyethylene glycol. In some embodiments, the half-life extending moiety is an Ig constant region.

In some embodiments, the half-life extending moiety is the Ig.

In some embodiments, the half-life extending moiety is the fragment of the Ig.

In some embodiments, the half-life extending moiety is the Ig constant region.

In some embodiments, the half-life extending moiety is the fragment of the Ig constant region.

In some embodiments, the half-life extending moiety is the Fc region.

In some embodiments, the half-life extending moiety is albumin.

In some embodiments, the half-life extending moiety is the albumin binding domain.

In some embodiments, the half-life extending moiety is transferrin.

In some embodiments, the half-life extending moiety is polyethylene glycol.

The antigen binding domains that bind HLA-G conjugated to a half-life extending moiety may be evaluated for their pharmacokinetic properties utilizing known in vivo models.

Conjugation to Immunoglobulin (Ig) Constant Regions or Fragments of the Ig Constant Regions The antigen binding domains that bind HLA-G of the disclosure may be conjugated to an Ig constant region or a fragment of the Ig constant region to impart antibody-like properties, including Fc effector functions C1q binding, complement dependent cytotoxicity (CDC), Fc receptor binding, antibody-dependent cell-mediated cytotoxicity (ADCC), phagocytosis or down regulation of cell surface receptors (e.g., B cell receptor; BCR). The Ig constant region or the fragment of the Ig constant region functions also as a half-life extending moiety as discussed herein. The antigen binding domains that bind HLA-G of the disclosure may be engineered into conventional full length antibodies using standard methods. The full length antibodies comprising the antigen binding domain that binds HLA-G may further be engineered as described herein.

Immunoglobulin heavy chain constant region comprised of subdomains CH1, hinge, CH2 and CH3. The CH1 domain spans residues A118-V215, the CH2 domain residues A231-K340 and the CH3 domain residues G341-K447 on the heavy chain, residue numbering according to the EU Index. In some instances G341 is referred as a CH2 domain residue. Hinge is generally defined as including E216 and terminating at P230 of human IgG1. Ig Fc region comprises at least the CH2 and the CH3 domains of the Ig constant region, and therefore comprises at least a region from about A231 to K447 of Ig heavy chain constant region.

The invention also provides an antigen binding domain that binds HLA-G conjugated to an immunoglobulin (Ig) constant region or a fragment of the Ig constant region.

In some embodiments, the Ig constant region is a heavy chain constant region

In some embodiments, the Ig constant region is a light chain constant region.

In some embodiments, the fragment of the Ig constant region comprises a Fc region.

In some embodiments, the fragment of the Ig constant region comprises a CH2 domain.

In some embodiments, the fragment of the Ig constant region comprises a CH3 domain.

In some embodiments, the fragment of the Ig constant region comprises the CH2 domain and the CH3 domain.

In some embodiments, the fragment of the Ig constant region comprises at least portion of a hinge, the CH2 domain and the CH3 domain. Portion of the hinge refers to one or more amino acid residues of the Ig hinge.

In some embodiments, the fragment of the Ig constant region comprises the hinge, the CH2 domain and the CH3 domain.

In some embodiments, the antigen binding domain that binds HLA-G is conjugated to the N-terminus of the Ig constant region or the fragment of the Ig constant region.

In some embodiments, the antigen binding domain that binds HLA-G is conjugated to the C-terminus of the Ig constant region or the fragment of the Ig constant region.

In some embodiments, the antigen binding domain that binds HLA-G is conjugated to the Ig constant region or the fragment of the Ig constant region via a second linker (L2).

In some embodiments, the L2 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40.

In some embodiments, the L2 comprises the amino acid sequence of SEQ ID NO: 8.

In some embodiments, the L2 comprises the amino acid sequence of SEQ ID NO: 9.

In some embodiments, the L2 comprises the amino acid sequence of SEQ ID NO: 10.

In some embodiments, the L2 comprises the amino acid sequence of SEQ ID NO: 11.

In some embodiments, the L2 comprises the amino acid sequence of SEQ ID NO: 12.

In some embodiments, the L2 comprises the amino acid sequence of SEQ ID NO: 13.

In some embodiments, the L2 comprises the amino acid sequence of SEQ ID NO: 14.

In some embodiments, the L2 comprises the amino acid sequence of SEQ ID NO: 15.

In some embodiments, the L2 comprises the amino acid sequence of SEQ ID NO: 16.

In some embodiments, the L2 comprises the amino acid sequence of SEQ ID NO: 17.

In some embodiments, the L2 comprises the amino acid sequence of SEQ ID NO: 18.

In some embodiments, the L2 comprises the amino acid sequence of SEQ ID NO: 19

In some embodiments, the L2 comprises the amino acid sequence of SEQ ID NO: 20.

In some embodiments, the L2 comprises the amino acid sequence of SEQ ID NO: 21.

In some embodiments, the L2 comprises the amino acid sequence of SEQ ID NO: 22.

In some embodiments, the L2 comprises the amino acid sequence of SEQ ID NO: 23.

In some embodiments, the L2 comprises the amino acid sequence of SEQ ID NO: 24.

In some embodiments, the L2 comprises the amino acid sequence of SEQ ID NO: 25.

In some embodiments, the L2 comprises the amino acid sequence of SEQ ID NO: 26.

In some embodiments, the L2 comprises the amino acid sequence of SEQ ID NO: 27.

In some embodiments, the L2 comprises the amino acid sequence of SEQ ID NO: 28.

In some embodiments, the L2 comprises the amino acid sequence of SEQ ID NO: 29.

In some embodiments, the L2 comprises the amino acid sequence of SEQ ID NO: 30.

In some embodiments, the L2 comprises the amino acid sequence of SEQ ID NO: 31.

In some embodiments, the L2 comprises the amino acid sequence of SEQ ID NO: 32.

In some embodiments, the L2 comprises the amino acid sequence of SEQ ID NO: 33.

In some embodiments, the L2 comprises the amino acid sequence of SEQ ID NO: 34.

In some embodiments, the L2 comprises the amino acid sequence of SEQ ID NO: 35.

In some embodiments, the L2 comprises the amino acid sequence of SEQ ID NO: 36.

In some embodiments, the L2 comprises the amino acid sequence of SEQ ID NO: 37.

In some embodiments, the L2 comprises the amino acid sequence of SEQ ID NO: 38.

In some embodiments, the L2 comprises the amino acid sequence of SEQ ID NO: 39.

In some embodiments, the L2 comprises the amino acid sequence of SEQ ID NO: 40.

The antigen binding domains that binds HLA-G of the disclosure conjugated to Ig constant region or the fragment of the Ig constant region may be assessed for their functionality using several known assays. Binding to HLA-G may be assessed using methods described herein. Altered properties imparted by the Ig constant domain or the fragment of the Ig constant region such as Fc region may be assayed in Fc receptor binding assays using soluble forms of the receptors, such as the FcγRI, FcγRII, FcγRIII or FcRn receptors, or using cell-based assays measuring for example ADCC, CDC or ADCP.

ADCC may be assessed using an in vitro assay using HLA-G expressing cells as target cells and NK cells as effector cells. Cytolysis may be detected by the release of label (e.g. radioactive substrates, fluorescent dyes or natural intracellular proteins) from the lysed cells. In an exemplary assay, target cells are used with a ratio of 1 target cell to 4 effector cells. Target cells are pre-labeled with BATDA and combined with effector cells and the test antibody. The samples are incubated for 2 hours and cell lysis measured by measuring released BATDA into the supernatant. Data is normalized to maximal cytotoxicity with 0.67% Triton X-100 (Sigma Aldrich) and minimal control determined by spontaneous release of BATDA from target cells in the absence of any antibody.

ADCP may be evaluated by using monocyte-derived macrophages as effector cells and any HLA-G expressing cells as target cells which are engineered to express GFP or other labeled molecule. In an exemplary assay, effector: target cell ratio may be for example 4:1. Effector cells may be incubated with target cells for 4 hours with or without the antibody of the invention. After incubation, cells may be detached using accutase. Macrophages may be identified with anti-CD11b and anti-CD14 antibodies coupled to a fluorescent label, and percent phagocytosis may be determined based on % GFP fluorescence in the $CD11^+CD14^+$ macrophages using standard methods.

CDC of cells may be measured for example by plating Daudi cells at $1 \times 10^5$ cells/well (50 µL/well) in RPMI-B (RPMI supplemented with 1% BSA), adding 50 µL of test protein to the wells at final concentration between 0-100 µg/mL, incubating the reaction for 15 min at room temperature, adding 11 µL of pooled human serum to the wells, and incubation the reaction for 45 min at 37° C. Percentage (%) lysed cells may be detected as % propidium iodide stained cells in FACS assay using standard methods.

Proteins Comprising the Antigen Binding Domains that Bind HLA-G of the Disclosure The antigen binding domains that bind HLA-G of the disclosure may be engineered into monospecific or multispecific proteins of various designs using standard methods.

The disclosure also provides a monospecific protein comprising the antigen binding domain that binds HLA-G of the disclosure.

In some embodiments, the monospecific protein is an antibody.

The disclosure also provides a multispecific protein comprising the antigen binding domain that binds HLA-G of the disclosure.

In some embodiments, the multispecific protein is bispecific.

In some embodiments, the multispecific protein is trispecific.

In some embodiments, the multispecific protein is tetraspecific.

In some embodiments, the multispecific protein is monovalent for binding to HLA-G.

In some embodiments, the multispecific protein is bivalent for binding to HLA-G.

The disclosure also provides an isolated multispecific protein comprising a first antigen binding domain that binds HLA-G and a second antigen binding domain that binds a lymphocyte antigen.

In some embodiments, the lymphocyte antigen is a T cell antigen.

In some embodiments, the T cell antigen is a $CD8^+$ T cell antigen.

In some embodiments, the lymphocyte antigen is a NK cell antigen.

In some embodiments, the lymphocyte antigen is CD3, CD3 epsilon (CD3E), CD8, KI2L4, NKG2E, NKG2D, NKG2F, BTNL3, CD186, BTNL8, PD-1, CD195, or NKG2C.

In some embodiments, the lymphocyte antigen is CD3E.

In some embodiments, the first antigen binding domain that binds HLA-G and/or the second antigen binding domain that binds the lymphocyte antigen comprise a scFv, a (scFv)$_2$, a Fv, a Fab, a F(ab')$_2$, a Fd, a dAb or a VHH.

In some embodiments, the first antigen binding domain that binds HLA-G and/or the second antigen binding domain that binds the lymphocyte antigen comprise the Fab.

In some embodiments, the first antigen binding domain that binds HLA-G and/or the second antigen binding domain that binds the lymphocyte antigen comprise the F(ab')$_2$.

In some embodiments, the first antigen binding domain that binds HLA-G and/or the second antigen binding domain that binds the lymphocyte antigen comprise the VHH.

In some embodiments, the first antigen binding domain that binds HLA-G and/or the second antigen binding domain that binds the lymphocyte antigen comprise the Fv.

In some embodiments, the first antigen binding domain that binds HLA-G and/or the second antigen binding domain that binds the lymphocyte antigen comprise the Fd.

In some embodiments, the first antigen binding domain that binds HLA-G and/or the second antigen binding domain that binds the lymphocyte antigen comprise the scFv.

In some embodiments, the scFv comprises, from the N- to C-terminus, a VH, a first linker (L1) and a VL (VH-L1-VL) or the VL, the L1 and the VH (VL-L1-VH).

In some embodiments, the L1 comprises about 5-50 amino acids.

In some embodiments, the L1 comprises about 5-40 amino acids.

In some embodiments, the L1 comprises about 10-30 amino acids.

In some embodiments, the L1 comprises about 10-20 amino acids.

In some embodiments, the L1 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40.

In some embodiments, the L1 comprises the amino acid sequence of SEQ ID NO: 8.

In some embodiments, the L1 comprises the amino acid sequence of SEQ ID NO: 9.

In some embodiments, the L1 comprises the amino acid sequence of SEQ ID NO: 10.

In some embodiments, the L1 comprises the amino acid sequence of SEQ ID NO: 11.

In some embodiments, the L1 comprises the amino acid sequence of SEQ ID NO: 12.

In some embodiments, the L1 comprises the amino acid sequence of SEQ ID NO: 13.

In some embodiments, the L1 comprises the amino acid sequence of SEQ ID NO: 14.

In some embodiments, the L1 comprises the amino acid sequence of SEQ ID NO: 15.

In some embodiments, the L1 comprises the amino acid sequence of SEQ ID NO: 16.

In some embodiments, the L1 comprises the amino acid sequence of SEQ ID NO: 17.

In some embodiments, the L1 comprises the amino acid sequence of SEQ ID NO: 18.

In some embodiments, the L1 comprises the amino acid sequence of SEQ ID NO: 19

In some embodiments, the L1 comprises the amino acid sequence of SEQ ID NO: 20.

In some embodiments, the L1 comprises the amino acid sequence of SEQ ID NO: 21.

In some embodiments, the L1 comprises the amino acid sequence of SEQ ID NO: 22.

In some embodiments, the L1 comprises the amino acid sequence of SEQ ID NO: 23.

In some embodiments, the L1 comprises the amino acid sequence of SEQ ID NO: 24.

In some embodiments, the L1 comprises the amino acid sequence of SEQ ID NO: 25.

In some embodiments, the L1 comprises the amino acid sequence of SEQ ID NO: 26.

In some embodiments, the L1 comprises the amino acid sequence of SEQ ID NO: 27.

In some embodiments, the L1 comprises the amino acid sequence of SEQ ID NO: 28.

In some embodiments, the L1 comprises the amino acid sequence of SEQ ID NO: 29.

In some embodiments, the L1 comprises the amino acid sequence of SEQ ID NO: 30.

In some embodiments, the L1 comprises the amino acid sequence of SEQ ID NO: 31.

In some embodiments, the L1 comprises the amino acid sequence of SEQ ID NO: 32.

In some embodiments, the L1 comprises the amino acid sequence of SEQ ID NO: 33.

In some embodiments, the L1 comprises the amino acid sequence of SEQ ID NO: 34.

In some embodiments, the L1 comprises the amino acid sequence of SEQ ID NO: 35.

In some embodiments, the L1 comprises the amino acid sequence of SEQ ID NO: 36.

In some embodiments, the L1 comprises the amino acid sequence of SEQ ID NO: 37.

In some embodiments, the L1 comprises the amino acid sequence of SEQ ID NO: 38.

In some embodiments, the L1 comprises the amino acid sequence of SEQ ID NO: 39.

In some embodiments, the L1 comprises the amino acid sequence of SEQ ID NO: 40.

In some embodiments, the first antigen binding domain that binds HLA-G comprises the HCDR1 of SEQ ID NOs: 70, 73, 75, 78, 81, or 85, the HCDR2 of SEQ ID NOs: 71, 76, 79, 82, or 86, the HCDR3 of SEQ ID NOs: 72, 74, 77, 80, 83, 84, or 87, the LCDR1 of SEQ ID NOs: 88, 91, 93, 95, 97, 99, 101, or 102, the LCDR2 of SEQ ID NOs: 89 or 103, and the LCDR3 of SEQ ID NOs: 90, 92, 94, 96, 98, 100, or 104.

In some embodiments, the first antigen binding domain that binds HLA-G comprises the HCDR1, the HCDR2, the HCDR3, the LCDR1, the LCDR2 and the LCDR3 of SEQ ID NOs: 70, 71, 72, 88, 89, and 90, respectively;
SEQ ID NOs: 73, 71, 74, 91, 89, and 92, respectively;
SEQ ID NOs: 75, 76, 77, 93, 89, and 94, respectively;
SEQ ID NOs: 78, 79, 80, 95, 89, and 96, respectively;
SEQ ID NOs: 81, 82, 83, 97, 89, and 98, respectively;
SEQ ID NOs: 78, 71, 84, 99, 89, and 100, respectively;
SEQ ID NOs: 78, 71, 84, 101, 89, and 100, respectively;
SEQ ID NOs: 85, 86, 87, 102, 103, and 104, respectively; or
SEQ ID NOs: 78, 71, 84, 95, 89, and 96, respectively.

In some embodiments, the first antigen binding domain that binds HLA-G comprises the VH of SEQ ID NO: 50 and the VL of SEQ ID NO: 51.

In some embodiments, the first antigen binding domain that binds HLA-G comprises the VH of SEQ ID NO: 52 and the VL of SEQ ID NO: 53.

In some embodiments, the first antigen binding domain that binds HLA-G comprises the VH of SEQ ID NO: 54 and the VL of SEQ ID NO: 55.

In some embodiments, the first antigen binding domain that binds HLA-G comprises the VH of SEQ ID NO: 56 and the VL of SEQ ID NO: 57.

In some embodiments, the first antigen binding domain that binds HLA-G comprises the VH of SEQ ID NO: 58 and the VL of SEQ ID NO: 59.

In some embodiments, the first antigen binding domain that binds HLA-G comprises the VH of SEQ ID NO: 60 and the VL of SEQ ID NO: 61.

In some embodiments, the first antigen binding domain that binds HLA-G comprises the VH of SEQ ID NO: 62 and the VL of SEQ ID NO: 63.

In some embodiments, the first antigen binding domain that binds HLA-G comprises the VH of SEQ ID NO: 64 and the VL of SEQ ID NO: 65.

In some embodiments, the first antigen binding domain that binds HLA-G comprises the VH of SEQ ID NO: 66 and the VL of SEQ ID NO: 67.

In some embodiments, the first antigen binding domain that binds HLA-G comprises the VH of SEQ ID NO: 68 and the VL of SEQ ID NO: 69.

In some embodiments, the first antigen binding domain that binds HLA-G comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

In some embodiments, the first antigen binding domain that binds HLA-G comprises:
the VH of SEQ ID NO: 50 and the VL of SEQ ID NO: 51;
the VH of SEQ ID NO: 50 and the VL of SEQ ID NO: 53;
the VH of SEQ ID NO: 50 and the VL of SEQ ID NO: 55;
the VH of SEQ ID NO: 50 and the VL of SEQ ID NO: 57;
the VH of SEQ ID NO: 50 and the VL of SEQ ID NO: 59;
the VH of SEQ ID NO: 50 and the VL of SEQ ID NO: 61;
the VH of SEQ ID NO: 50 and the VL of SEQ ID NO: 63;
the VH of SEQ ID NO: 50 and the VL of SEQ ID NO: 65;
the VH of SEQ ID NO: 50 and the VL of SEQ ID NO: 67;
the VH of SEQ ID NO: 50 and the VL of SEQ ID NO: 69;
the VH of SEQ ID NO: 52 and the VL of SEQ ID NO: 51;
the VH of SEQ ID NO: 52 and the VL of SEQ ID NO: 53;
the VH of SEQ ID NO: 52 and the VL of SEQ ID NO: 55;
the VH of SEQ ID NO: 52 and the VL of SEQ ID NO: 57;
the VH of SEQ ID NO: 52 and the VL of SEQ ID NO: 59;
the VH of SEQ ID NO: 52 and the VL of SEQ ID NO: 61;
the VH of SEQ ID NO: 52 and the VL of SEQ ID NO: 63;
the VH of SEQ ID NO: 52 and the VL of SEQ ID NO: 65;
the VH of SEQ ID NO: 52 and the VL of SEQ ID NO: 67;
the VH of SEQ ID NO: 52 and the VL of SEQ ID NO: 69;
the VH of SEQ ID NO: 54 and the VL of SEQ ID NO: 51;
the VH of SEQ ID NO: 54 and the VL of SEQ ID NO: 53;
the VH of SEQ ID NO: 54 and the VL of SEQ ID NO: 55;
the VH of SEQ ID NO: 54 and the VL of SEQ ID NO: 57;
the VH of SEQ ID NO: 54 and the VL of SEQ ID NO: 59;
the VH of SEQ ID NO: 54 and the VL of SEQ ID NO: 61;
the VH of SEQ ID NO: 54 and the VL of SEQ ID NO: 63;
the VH of SEQ ID NO: 54 and the VL of SEQ ID NO: 65;
the VH of SEQ ID NO: 54 and the VL of SEQ ID NO: 67;
the VH of SEQ ID NO: 54 and the VL of SEQ ID NO: 69;
the VH of SEQ ID NO: 56 and the VL of SEQ ID NO: 51;
the VH of SEQ ID NO: 56 and the VL of SEQ ID NO: 53;
the VH of SEQ ID NO: 56 and the VL of SEQ ID NO: 55;
the VH of SEQ ID NO: 56 and the VL of SEQ ID NO: 57;
the VH of SEQ ID NO: 56 and the VL of SEQ ID NO: 59;
the VH of SEQ ID NO: 56 and the VL of SEQ ID NO: 61;
the VH of SEQ ID NO: 56 and the VL of SEQ ID NO: 63;
the VH of SEQ ID NO: 56 and the VL of SEQ ID NO: 65;
the VH of SEQ ID NO: 56 and the VL of SEQ ID NO: 67;
the VH of SEQ ID NO: 56 and the VL of SEQ ID NO: 69;
the VH of SEQ ID NO: 58 and the VL of SEQ ID NO: 51;
the VH of SEQ ID NO: 58 and the VL of SEQ ID NO: 53;
the VH of SEQ ID NO: 58 and the VL of SEQ ID NO: 55;
the VH of SEQ ID NO: 58 and the VL of SEQ ID NO: 57;
the VH of SEQ ID NO: 58 and the VL of SEQ ID NO: 59;
the VH of SEQ ID NO: 58 and the VL of SEQ ID NO: 61;
the VH of SEQ ID NO: 58 and the VL of SEQ ID NO: 63;
the VH of SEQ ID NO: 58 and the VL of SEQ ID NO: 65;
the VH of SEQ ID NO: 58 and the VL of SEQ ID NO: 67;
the VH of SEQ ID NO: 58 and the VL of SEQ ID NO: 69;
the VH of SEQ ID NO: 60 and the VL of SEQ ID NO: 51;
the VH of SEQ ID NO: 60 and the VL of SEQ ID NO: 53;
the VH of SEQ ID NO: 60 and the VL of SEQ ID NO: 55;
the VH of SEQ ID NO: 60 and the VL of SEQ ID NO: 57;
the VH of SEQ ID NO: 60 and the VL of SEQ ID NO: 59;
the VH of SEQ ID NO: 60 and the VL of SEQ ID NO: 61;
the VH of SEQ ID NO: 60 and the VL of SEQ ID NO: 63;
the VH of SEQ ID NO: 60 and the VL of SEQ ID NO: 65;
the VH of SEQ ID NO: 60 and the VL of SEQ ID NO: 67;
the VH of SEQ ID NO: 60 and the VL of SEQ ID NO: 69;
the VH of SEQ ID NO: 62 and the VL of SEQ ID NO: 51;
the VH of SEQ ID NO: 62 and the VL of SEQ ID NO: 53;
the VH of SEQ ID NO: 62 and the VL of SEQ ID NO: 55;
the VH of SEQ ID NO: 62 and the VL of SEQ ID NO: 57;
the VH of SEQ ID NO: 62 and the VL of SEQ ID NO: 59;
the VH of SEQ ID NO: 62 and the VL of SEQ ID NO: 61;
the VH of SEQ ID NO: 62 and the VL of SEQ ID NO: 63;
the VH of SEQ ID NO: 62 and the VL of SEQ ID NO: 65;
the VH of SEQ ID NO: 62 and the VL of SEQ ID NO: 67;
the VH of SEQ ID NO: 62 and the VL of SEQ ID NO: 69;
the VH of SEQ ID NO: 64 and the VL of SEQ ID NO: 51;
the VH of SEQ ID NO: 64 and the VL of SEQ ID NO: 53;
the VH of SEQ ID NO: 64 and the VL of SEQ ID NO: 55;
the VH of SEQ ID NO: 64 and the VL of SEQ ID NO: 57;
the VH of SEQ ID NO: 64 and the VL of SEQ ID NO: 59;
the VH of SEQ ID NO: 64 and the VL of SEQ ID NO: 61;
the VH of SEQ ID NO: 64 and the VL of SEQ ID NO: 63;
the VH of SEQ ID NO: 64 and the VL of SEQ ID NO: 65;
the VH of SEQ ID NO: 64 and the VL of SEQ ID NO: 67;
the VH of SEQ ID NO: 64 and the VL of SEQ ID NO: 69;
the VH of SEQ ID NO: 66 and the VL of SEQ ID NO: 51;
the VH of SEQ ID NO: 66 and the VL of SEQ ID NO: 53;
the VH of SEQ ID NO: 66 and the VL of SEQ ID NO: 55;
the VH of SEQ ID NO: 66 and the VL of SEQ ID NO: 57;
the VH of SEQ ID NO: 66 and the VL of SEQ ID NO: 59;
the VH of SEQ ID NO: 66 and the VL of SEQ ID NO: 61;
the VH of SEQ ID NO: 66 and the VL of SEQ ID NO: 63;
the VH of SEQ ID NO: 66 and the VL of SEQ ID NO: 65;
the VH of SEQ ID NO: 66 and the VL of SEQ ID NO: 67;
the VH of SEQ ID NO: 66 and the VL of SEQ ID NO: 69;
the VH of SEQ ID NO: 68 and the VL of SEQ ID NO: 51;
the VH of SEQ ID NO: 68 and the VL of SEQ ID NO: 53;
the VH of SEQ ID NO: 68 and the VL of SEQ ID NO: 55;
the VH of SEQ ID NO: 68 and the VL of SEQ ID NO: 57;
the VH of SEQ ID NO: 68 and the VL of SEQ ID NO: 59;
the VH of SEQ ID NO: 68 and the VL of SEQ ID NO: 61;
the VH of SEQ ID NO: 68 and the VL of SEQ ID NO: 63;
the VH of SEQ ID NO: 68 and the VL of SEQ ID NO: 65;
the VH of SEQ ID NO: 68 and the VL of SEQ ID NO: 67;
or
the VH of SEQ ID NO: 68 and the VL of SEQ ID NO: 69.

In some embodiments, the first antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

In some embodiments, the first antigen binding domain that binds HLA-G comprises the amino acid sequence of SEQ ID NO: 248.

In some embodiments, the first antigen binding domain that binds HLA-G comprises the amino acid sequence of SEQ ID NO: 249.

In some embodiments, the first antigen binding domain that binds HLA-G comprises the amino acid sequence of SEQ ID NO: 250.

In some embodiments, the first antigen binding domain that binds HLA-G comprises the amino acid sequence of SEQ ID NO: 251.

In some embodiments, the first antigen binding domain that binds HLA-G comprises the amino acid sequence of SEQ ID NO: 252.

In some embodiments, the first antigen binding domain that binds HLA-G comprises the amino acid sequence of SEQ ID NO: 253.

In some embodiments, the first antigen binding domain that binds HLA-G comprises the amino acid sequence of SEQ ID NO: 254.

In some embodiments, the first antigen binding domain that binds HLA-G comprises the amino acid sequence of SEQ ID NO: 255.

In some embodiments, the first antigen binding domain that binds HLA-G comprises the amino acid sequence of SEQ ID NO: 256.

In some embodiments, the first antigen binding domain that binds HLA-G comprises the amino acid sequence of SEQ ID NO: 257.

In some embodiments, the first antigen binding domain that binds HLA-G comprises the amino acid sequence of SEQ ID NO: 258.

In some embodiments, the first antigen binding domain that binds HLA-G comprises the amino acid sequence of SEQ ID NO: 259.

In some embodiments, the first antigen binding domain that binds HLA-G comprises the amino acid sequence of SEQ ID NO: 260.

In some embodiments, the first antigen binding domain that binds HLA-G comprises the amino acid sequence of SEQ ID NO: 261.

In some embodiments, the first antigen binding domain that binds HLA-G comprises the amino acid sequence of SEQ ID NO: 262.

In some embodiments, the first antigen binding domain that binds HLA-G comprises the amino acid sequence of SEQ ID NO: 263.

In some embodiments, the first antigen binding domain that binds HLA-G comprises the amino acid sequence of SEQ ID NO: 264.

In some embodiments, the first antigen binding domain that binds HLA-G comprises the amino acid sequence of SEQ ID NO: 265.

In some embodiments, the first antigen binding domain that binds HLA-G comprises the amino acid sequence of SEQ ID NO: 266.

In some embodiments, the first antigen binding domain that binds HLA-G comprises the amino acid sequence of SEQ ID NO: 267.

In some embodiments, the first antigen binding domain that binds HLA-G comprises the amino acid sequence of SEQ ID NO: 268.

In some embodiments, the first antigen binding domain that binds HLA-G comprises the amino acid sequence of SEQ ID NO: 269.

In some embodiments, the second antigen binding domain that binds a lymphocyte antigen comprises
the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 370; the VH of SEQ ID NO: 339 and the VL of SEQ ID NOs: 340, 341, 342, 343, 344, or 345;
the HCDR1 of SEQ ID NO: 364, the HCDR2 of SEQ ID NO: 365, the HCDR3 of SEQ ID NO: 366, the LCDR1 of SEQ ID NO: 371, the LCDR2 of SEQ ID NO: 372 and the LCDR3 of SEQ ID NO: 373; or
the VH of SEQ ID NO: 346 or 348 and the VL of SEQ ID NO: 347 or 349.

In some embodiments, the first antigen binding domain that binds HLA-G is conjugated to a first immunoglobulin (Ig) constant region or a fragment of the first Ig constant region and/or the second antigen binding domain that binds the lymphocyte antigen is conjugated to a second immunoglobulin (Ig) constant region or a fragment of the second Ig constant region.

In some embodiments, the fragment of the first Ig constant region and/or the fragment of the second Ig constant region comprises a Fc region.

In some embodiments, the fragment of the first Ig constant region and/or the fragment of the second Ig constant region comprises a CH2 domain.

In some embodiments, the fragment of the first Ig constant region and/or the fragment of the second Ig constant region comprises a CH3 domain.

In some embodiments, the fragment of the first Ig constant region and/or the fragment of the second Ig constant region comprises the CH2 domain and the CH3 domain.

In some embodiments, the fragment of the first Ig constant region and/or the fragment of the second Ig constant region comprises at least portion of a hinge, the CH2 domain and the CH3 domain.

In some embodiments, the fragment of the Ig constant region comprises the hinge, the CH2 domain and the CH3 domain.

In some embodiments, the multispecific protein further comprises a second linker (L2) between the first antigen binding domain that binds HLA-G and the first Ig constant region or the fragment of the first Ig constant region and the second antigen binding domain that binds the lymphocyte antigen and the second Ig constant region or the fragment of the second Ig constant region.

In some embodiments, the L2 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40.

In some embodiments, the first Ig constant region or the fragment of the first Ig constant region and the second Ig constant region or the fragment of the second Ig constant region is an IgG1, an IgG2, and IgG3 or an IgG4 isotype.

In some embodiments, the first Ig constant region or the fragment of the first Ig constant region and the second Ig constant region or the fragment of the second Ig constant region is an IgG1 isotype.

In some embodiments, the first Ig constant region or the fragment of the first Ig constant region and the second Ig constant region or the fragment of the second Ig constant region is an IgG2 isotype.

In some embodiments, the first Ig constant region or the fragment of the first Ig constant region and the second Ig constant region or the fragment of the second Ig constant region is an IgG3 isotype.

In some embodiments, the first Ig constant region or the fragment of the first Ig constant region and the second Ig constant region or the fragment of the second Ig constant region is an IgG4 isotype.

The first Ig constant region or the fragment of the first Ig constant region and the second Ig constant region or the fragment of the second Ig constant region can further be engineered as described herein.

In some embodiments, the first Ig constant region or the fragment of the first Ig constant region and the second Ig constant region or the fragment of the second Ig constant region comprises at least one mutation that results in reduced binding of the multispecific protein to a FcγR.

In some embodiments, the at least one mutation that results in reduced binding of the multispecific protein to the FcγR is selected from the group consisting of L235A/D265S, F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index. In some embodiments, the at least one mutation that results in reduced binding of the multispecific protein to the FcγR is L234A/L235A/D265S.

In some embodiments, the first Ig constant region or the fragment of the first Ig constant region and the second Ig constant region or the fragment of the second Ig constant region comprises at least one mutation that results in enhanced binding of the multispecific protein to a Fcγ receptor (FcγR).

In some embodiments, the at least one mutation that results in enhanced binding of the multispecific protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

In some embodiments, the FcγR is FcγRI, FcγRIIA, FcγRIIB or FcγRIII, or any combination thereof.

In some embodiments, the first Ig constant region or the fragment of the first Ig constant region and the second Ig constant region or the fragment of the second Ig constant region comprises at least one mutation that modulates a half-life of the multispecific protein.

In some embodiments, the at least one mutation that modulates the half-life of the multispecific protein is selected from the group consisting of H435A, P257I/N434H, D376V/N434H, M252Y/S254T/T256E/H433K/N434F, T308P/N434A and H435R, wherein residue numbering is according to the EU index.

In some embodiments, the multispecific protein comprises at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region.

In some embodiments, the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region is selected from the group consisting of T350V, L351Y, F405A, Y407V, T366Y, T366W, F405W, T394W, T394S, Y407T, Y407A, T366S/L368A/Y407V, L351Y/F405A/Y407V, T366I/K392M/T394W, F405A/Y407V, T366L/K392M/T394W, L351Y/Y407A, T366A/K409F, L351Y/Y407A, T366V/K409F, T366A/K409F, T350V/L351Y/F405A/Y407V and T350V/T366L/K392L/T394W, wherein residue numbering is according to the EU index.

In some embodiments, the first Ig constant region or the fragment of the first Ig constant region and the second Ig constant region or the fragment of the second Ig constant region comprise the following mutations
L235A_D265S_T350V_L351Y_F405A_Y407V in the first Ig constant region and
L235A_D265S_T350V_T366L_K392L_T394W in the second Ig constant region; or
L235A_D265S_T350V_T366L_K392L_T394W in the first Ig constant region and
L235A_D265S_T350V_L351Y_F405A_Y407V in the second Ig constant region.

Generation of Multispecific Proteins that Comprise Antigen Binding Fragments that Bind HLA-G The antigen binding fragments that bind HLA-G of the disclosure may be engineered into multispecific antibodies which are also encompassed within the scope of the invention.

The antigen binding fragments that bind HLA-G may be engineered into full length multispecific antibodies which are generated using Fab arm exchange, in which substitutions are introduced into two monospecific bivalent antibodies within the Ig constant region CH3 domain which promote Fab arm exchange in vitro. In the methods, two monospecific bivalent antibodies are engineered to have certain substitutions at the CH3 domain that promote heterodimer stability; the antibodies are incubated together under reducing conditions sufficient to allow the cysteines in the hinge region to undergo disulfide bond isomerization; thereby generating the bispecific antibody by Fab arm exchange. The incubation conditions may optimally be restored to non-reducing. Exemplary reducing agents that may be used are 2-mercaptoethylamine (2-MEA), dithiothreitol (DTT), dithioerythritol (DTE), glutathione, tris(2-carboxyethyl)phosphine (TCEP), L-cysteine and beta-mercaptoethanol, preferably a reducing agent selected from the group consisting of: 2-mercaptoethylamine, dithiothreitol and tris(2-carboxyethyl)phosphine. For example, incubation for at least 90 min at a temperature of at least 20° C. in the presence of at least 25 mM 2-MEA or in the presence of at least 0.5 mM dithiothreitol at a pH of from 5-8, for example at pH of 7.0 or at pH of 7.4 may be used.

CH3 mutations that may be used include technologies such as Knob-in-Hole mutations (Genentech), electrostatically-matched mutations (Chugai, Amgen, NovoNordisk, Oncomed), the Strand Exchange Engineered Domain body (SEEDbody) (EMD Serono), Duobody® mutations (Genmab), and other asymmetric mutations (e.g. Zymeworks).

Knob-in-hole mutations are disclosed for example in WO1996/027011 and include mutations on the interface of CH3 region in which an amino acid with a small side chain (hole) is introduced into the first CH3 region and an amino acid with a large side chain (knob) is introduced into the second CH3 region, resulting in preferential interaction between the first CH3 region and the second CH3 region. Exemplary CH3 region mutations forming a knob and a hole are T366Y/F405A, T366W/F405W, F405W/Y407A, T394W/Y407T, T394S/Y407A, T366W/T394S, F405W/T394S and T366W/I366S_L368A_Y407V.

Heavy chain heterodimer formation may be promoted by using electrostatic interactions by substituting positively charged residues on the first CH3 region and negatively charged residues on the second CH3 region as described in US2010/0015133, US2009/0182127, US2010/028637 or US2011/0123532.

Other asymmetric mutations that can be used to promote heavy chain heterodimerization are L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

SEEDbody mutations involve substituting select IgG residues with IgA residues to promote heavy chai heterodimerization as described in US20070287170.

Other exemplary mutations that may be used are R409D_K370E/D399K_E357K, S354C_T366W/Y349C_T366S_L368A_Y407V, Y349C_T366W/S354C_T366S_L368A_Y407V, T366K/L351D, L351K/Y349E, L351K/Y349D, L351K/L368E, L351Y_Y407A/T366A_K409F, L351Y_Y407A/T366V_K409F, K392D/D399K, K392D/E356K, K253E_D282K_K322D/D239K_E240K_K292D, K392D_K409D/D356K_D399K as described in WO2007/147901, WO 2011/143545, WO2013157954, WO2013096291 and US2018/0118849.

Duobody® mutations (Genmab) are disclosed for example in U.S. Pat. No. 9,150,663 and US2014/0303356 and include mutations F405L/K409R, wild-type/F405L_R409K, T350I_K370T_F405L/K409R, K370W/K409R, D399AFGHILMNRSTVWY/K409R, T366ADEFGHILMQVY/K409R, L368ADEGHNRSTVQ/K409AGRH, D399FHKRQ/K409AGRH, F405IKLSTVW/K409AGRH and Y407LWQ/K409AGRH.

Additional bispecific or multispecific structures into which the antigen binding domains that bind HLA-G can be incorporated include Dual Variable Domain Immunoglobulins (DVD) (Int. Pat. Publ. No. WO2009/134776; DVDs are full length antibodies comprising the heavy chain having a structure VH1-linker-VH2-CH and the light chain having the structure VL1-linker-VL2-CL; linker being optional), structures that include various dimerization domains to connect the two antibody arms with different specificity, such as leucine zipper or collagen dimerization domains (Int. Pat. Publ. No. WO2012/022811, U.S. Pat. Nos. 5,932,448; 6,833,441), two or more domain antibodies (dAbs) conjugated together, diabodies, heavy chain only antibodies such as camelid antibodies and engineered camelid antibodies, Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer), IgG-like Bispecific (InnClone/Eli Lilly), Ts2Ab (MedImmune/AZ) and BsAb (Zymogenetics), HERCULES (Biogen Idec) and TvAb (Roche), ScFv/Fc Fusions (Academic Institution), SCORPION (Emergent BioSolutions/Trubion, Zymogenetics/BMS), Dual Affinity Retargeting Technology (Fc-DART) (MacroGenics) and Dual(ScFv)$_2$-Fab (National Research Center for Antibody Medicine—China), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based, and domain antibodies, include but are not limited to, Bispecific T Cell Engager (BiTE) (Micromet), Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

The antigen binding domains that bind HLA-G of the disclosure may also be engineered into multispecific proteins which comprise three polypeptide chains. In such designs, at least one antigen binding domain is in the form of a scFv. Exemplary designs include (in which "1" indicates the first antigen binding domain, "2" indicates the second antigen binding domain and "3" indicates the third antigen binding domain:

Design 1: Chain A) scFv1-CH2-CH3; Chain B) VL2-CL; Chain C) VH2-CH1-hinge-CH2-CH3

Design 2: Chain A) scFv1-hinge-CH2-CH3; Chain B) VL2-CL; Chain C) VH2-CH1-hinge-CH2-CH3

Design 3: Chain A) scFv1-CH1-hinge-CH2-CH3; Chain B) VL2-CL; Chain C) VH2-CH1-hinge-CH2-CH3

Design 4: Chain A) CH2-CH3-scFv1; Chain B) VL2-CL; Chain C) VH2-CH1-hinge-CH2-CH3

CH3 engineering may be incorporated to the Designs 1-4, such as mutations L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

Isotypes, Allotypes and Fc Engineering

The Ig constant region or the fragment of the Ig constant region, such as the Fc region present in the proteins of the disclosure may be of any allotype or isotype.

In some embodiments, the Ig constant region or the fragment of the Ig constant region is an IgG1 isotype.

In some embodiments, the Ig constant region or the fragment of the Ig constant region is an IgG2 isotype.

In some embodiments, the Ig constant region or the fragment of the Ig constant region is an IgG3 isotype.

In some embodiments, the Ig constant region or the fragment of the Ig constant region is an IgG4 isotype.

The Ig constant region or the fragment of the Ig constant region may be of any allotype. It is expected that allotype has no influence on properties of the Ig constant region, such as binding or Fc-mediated effector functions. Immunogenicity of therapeutic proteins comprising Ig constant regions of fragments thereof is associated with increased risk of infusion reactions and decreased duration of therapeutic response (Baert et al., (2003) *N Engl J Med* 348:602-08). The extent to which therapeutic proteins comprising Ig constant regions of fragments thereof induce an immune response in the host may be determined in part by the allotype of the Ig constant region (Stickler et al., (2011) *Genes and Immunity* 12:213-21). Ig constant region allotype is related to amino acid sequence variations at specific locations in the constant region sequences of the antibody. Table 3 shows select IgG1, IgG2 and IgG4 allotypes.

TABLE 3

| | Amino acid residue at position of diversity (residue numbering: EU Index) | | | | | | | |
|---|---|---|---|---|---|---|---|---|
| | IgG2 | | IgG4 | | IgG1 | | | |
| Allotype | 189 | 282 | 309 | 422 | 214 | 356 | 358 | 431 |
| G2m(n) | T | M | | | | | | |
| G2m(n−) | P | V | | | | | | |

TABLE 3-continued

Amino acid residue at position of diversity (residue numbering: EU Index)

| | IgG2 | | IgG4 | | IgG1 | | | |
|---|---|---|---|---|---|---|---|---|
| Allotype | 189 | 282 | 309 | 422 | 214 | 356 | 358 | 431 |
| G2m(n)/(n−) | T | V | | | | | | |
| nG4m(a) | | | L | R | | | | |
| G1m(17) | | | | | K | E | M | A |
| G1m(17, 1) | | | | | K | D | L | A |
| G1m(3) | | | | | R | E | M | A |

C-terminal lysine (CTL) may be removed from the Ig constant region by endogenous circulating carboxypeptidases in the blood stream (Cai et al., (2011) *Biotechnol Bioeng* 108:404-412). During manufacturing, CTL removal may be controlled to less than the maximum level by control of concentration of extracellular $Zn^{2+}$, EDTA or EDTA-$Fe^{3+}$ as described in U.S. Patent Publ. No. US20140273092. CTL content of proteins may be measured using known methods.

In some embodiments, the antigen binding fragment that binds HLA-G conjugated to the Ig constant region has a C-terminal lysine content from about 10% to about 90%. In some embodiments, the C-terminal lysine content is from about 20% to about 80%. In some embodiments, the C-terminal lysine content is from about 40% to about 70%. In some embodiments, the C-terminal lysine content is from about 55% to about 70%. In some embodiments, the C-terminal lysine content is about 60%.

Fc region mutations may be made to the antigen binding domains that bind HLA-G conjugated to the Ig constant region or to the fragment of the Ig constant region to modulate their effector functions such as ADCC, ADCP and/or ADCP and/or pharmacokinetic properties. This may be achieved by introducing mutation(s) into the Fc that modulate binding of the mutated Fc to activating FcγRs (FcγRI, FcγRIIa, FcγRIII), inhibitory FcγRIIb and/or to FcRn.

In some embodiments, the antigen binding domain that binds HLA-Gs conjugated to the Ig constant region or the fragment of the Ig constant region comprises at least one mutation in the Ig constant region or in the fragment of the Ig constant region.

In some embodiments, the at least one mutation is in the Fc region.

In some embodiments, the antigen binding domain that binds HLA-G conjugated to the Ig constant region or to the fragment of the Ig constant region comprises at least one, two, three, four, five, six, seven, eight, nine, ten, eleven, twelve, thirteen, fourteen or fifteen mutations in the Fc region.

In some embodiments, the antigen binding domain that binds HLA-Gs conjugated to the Ig constant region or to the fragment of the Ig constant region comprises at least one mutation in the Fc region that modulates binding of the antibody to FcRn.

Fc positions that may be mutated to modulate half-life (e.g. binding to FcRn) include positions 250, 252, 253, 254, 256, 257, 307, 376, 380, 428, 434 and 435. Exemplary mutations that may be made singularly or in combination are mutations T250Q, M252Y, I253A, S254T, T256E, P257I, T307A, D376V, E380A, M428L, H433K, N434S, N434A, N434H, N434F, H435A and H435R. Exemplary singular or combination mutations that may be made to increase the half-life are mutations M428L/N434S, M252Y/S254T/T256E, T250Q/M428L, N434A and T307A/E380A/N434A.

Exemplary singular or combination mutations that may be made to reduce the half-life are mutations H435A, P257I/N434H, D376V/N434H, M252Y/S254T/T256E/H433K/N434F, T308P/N434A and H435R.

In some embodiments, the antigen binding domain that binds HLA-G conjugated to the Ig constant region or to the fragment of the Ig constant region comprises M252Y/S254T/T256E mutation.

In some embodiments, the antigen binding domain that binds HLA-G conjugated to the Ig constant region or to the fragment of the Ig constant region comprises at least one mutation in the Fc region that reduces binding of the protein to an activating Fcγ receptor (FcγR) and/or reduces Fc effector functions such as C1q binding, complement dependent cytotoxicity (CDC), antibody-dependent cell-mediated cytotoxicity (ADCC) or phagocytosis (ADCP).

Fc positions that may be mutated to reduce binding of the protein to the activating FcγR and subsequently to reduce effector function include positions 214, 233, 234, 235, 236, 237, 238, 265, 267, 268, 270, 295, 297, 309, 327, 328, 329, 330, 331 and 365. Exemplary mutations that may be made singularly or in combination are mutations K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, A330S and P331S in IgG1, IgG2, IgG3 or IgG4. Exemplary combination mutations that result in proteins with reduced ADCC are mutations L234A/L235A on IgG1, L234A/L235A/D265S on IgG1, V234A/G237A/P238S/H268A/V309L/A330S/P331S on IgG2, F234A/L235A on IgG4, S228P/F234A/L235A on IgG4, N297A on all Ig isotypes, V234A/G237A on IgG2, K214T/E233P/L234V/L235A/G236-deleted/A327G/P331A/D365E/L358M on IgG1, H268Q/V309L/A330S/P331S on IgG2, S267E/L328F on IgG1, L234F/L235E/D265A on IgG1, L234A/L235A/G237A/P238S/H268A/A330S/P331S on IgG1, S228P/F234A/L235A/G237A/P238S on IgG4, and S228P/F234A/L235A/G236-deleted/G237A/P238S on IgG4. Hybrid IgG2/4 Fc domains may also be used, such as Fc with residues 117-260 from IgG2 and residues 261-447 from IgG4.

Exemplary mutation that result in proteins with reduced CDC is a K322A mutation.

Well-known S228P mutation may be made in IgG4 to enhance IgG4 stability.

In some embodiments, the antigen binding domain that binds HLA-G conjugated to the Ig constant region or to the fragment of the Ig constant region comprises at least one mutation selected from the group consisting of K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, K322, A330S and P331S.

In some embodiments, the antigen binding domain that binds HLA-G conjugated to the Ig constant region or to the fragment of the Ig constant region comprises L234A/L235A/D265S mutation.

In some embodiments, the antigen binding domain that binds HLA-G conjugated to the Ig constant region or to the fragment of the Ig constant region comprises L234A/L235A mutation.

In some embodiments, the antigen binding domain that binds HLA-G conjugated to the Ig constant region or to the fragment of the Ig constant region comprises at least one mutation in the Fc region that enhances binding of the protein to an Fcγ receptor (FcγR) and/or enhances Fc effector functions such as C1q binding, complement dependent cytotoxicity (CDC), antibody-dependent cell-mediated cytotoxicity (ADCC) and/or phagocytosis (ADCP).

Fc positions that may be mutated to increase binding of the protein to the activating FcγR and/or enhance Fc effector functions include positions 236, 239, 243, 256, 290, 292, 298, 300, 305, 312, 326, 330, 332, 333, 334, 345, 360, 339, 378, 396 or 430 (residue numbering according to the EU index). Exemplary mutations that may be made singularly or in combination are G236A, S239D, F243L, T256A, K290A, R292P, S298A, Y300L, V305L, K326A, A330K, I332E, E333A, K334A, A339T and P396L. Exemplary combination mutations that result in proteins with increased ADCC or ADCP are a S239D/I332E, S298A/E333A/K334A, F243L/R292P/Y300L, F243L/R292P/Y300L/P396L, F243L/R292P/Y300L/V305I/P396L and G236A/S239D/I332E.

Fc positions that may be mutated to enhance CDC include positions 267, 268, 324, 326, 333, 345 and 430. Exemplary mutations that may be made singularly or in combination are S267E, F1268F, S324T, K326A, K326W, E333A, E345K, E345Q, E345R, E345Y, E430S, E430F and E430T. Exemplary combination mutations that result in proteins with increased CDC are K326A/E333A, K326W/E333A, H268F/S324T, S267E/H268F, S267E/S324T and S267E/H268F/S324T.

The specific mutations described herein are mutations when compared to the IgG1, IgG2 and IgG4 wild-type amino acid sequences of SEQ ID NOs: 130, 131 and 132, respectively.

wild-type IgG1,
SEQ ID NO: 486
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLT

VDKSRWQQGNVFSCSVMHEALHNHYTQKSLSLSPGK wild-type IgG2;
SEQ ID NO: 487
ASTKGPSVFPLAPCSRSTSESTAALGCLVKDYFPEPVTVSWNSGALTSG

VHTFPAVLQSSGLYSLSSVVTVPSSNFGTQTYTCNVDHKPSNTKVDKTV

ERKCCVECPPCPAPPVAGPSVFLFPPKPKDTLMISRTPEVTCVVVDVSH

EDPEVQFNWYVDGVEVHNAKTKPREEQFNSTFRVVSVLTVVHQDWLNGK

EYKCKVSNKGLPAPIEKTISKTKGQPREPQVYTLPPSREEMTKNQVSLT

CLVKGFYPSDISVEWESNGQPENNYKTTPPMLDSDGSFFLYSKLTVDKS

RWQQGNVFSCSVMHEALHNHYTQKSLSLSPGK wild-type IgG4;
SEQ ID NO: 488
ASTKGPSVFPLAPCSRSTSESTAALGCLVKDYFPEPVTVSWNSGALTSG

VHTFPAVLQSSGLYSLSSVVTVPSSSLGTKTYTCNVDHKPSNTKVDKRV

ESKYGPPCPSCPAPEFLGGPSVFLFPPKPKDTLMISRTPEVTCVVVDVS

QEDPEVQFNWYVDGVEVHNAKTKPREEQFNSTYRVVSVLTVLHQDWLNG

KEYKCKVSNKGLPSSIEKTISKAKGQPREPQVYTLPPSQEEMTKNQVSL

TCLVKGFYPSDIAVEWESNGQPENNYKTTPPVLDSDGSFFLYSRLTVDK

SRWQEGNVFSCSVMHEALHNHYTQKSLSLSLGK

Binding of the antibody to FcγR or FcRn may be assessed on cells engineered to express each receptor using flow cytometry. In an exemplary binding assay, 2×10⁵ cells per well are seeded in 96-well plate and blocked in BSA Stain Buffer (BD Biosciences, San Jose, USA) for 30 min at 4° C. Cells are incubated with a test antibody on ice for 1.5 hour at 4° C. After being washed twice with BSA stain buffer, the cells are incubated with R-PE labeled anti-human IgG secondary antibody (Jackson Immunoresearch Laboratories) for 45 min at 4° C. The cells are washed twice in stain buffer and then resuspended in 150 µL of Stain Buffer containing 1:200 diluted DRAQ7 live/dead stain (Cell Signaling Technology, Danvers, USA). PE and DRAQ7 signals of the stained cells are detected by Miltenyi MACSQuant flow cytometer (Miltenyi Biotec, Auburn, USA) using B2 and B4 channel respectively. Live cells are gated on DRAQ7 exclusion and the geometric mean fluorescence signals are determined for at least 10,000 live events collected. FlowJo software (Tree Star) is used for analysis. Data is plotted as the logarithm of antibody concentration versus mean fluorescence signals. Nonlinear regression analysis is performed.

Glycoengineering

The ability of the antigen binding domain that binds HLA-G conjugated to the Ig constant region or to the fragment of the Ig constant region to mediate ADCC can be enhanced by engineering the Ig constant region or the fragment of the Ig constant region oligosaccharide component. Human IgG1 or IgG3 are N-glycosylated at Asn297 with the majority of the glycans in the well-known biantennary G0, G0F, G1, G1F, G2 or G2F forms. Ig constant region containing proteins may be produced by non-engineered CHO cells typically have a glycan fucose content of about at least 85%. The removal of the core fucose from the biantennary complex-type oligosaccharides attached to the antigen binding domain that binds HLA-G conjugated to the Ig constant region or to the fragment of the Ig constant region enhances the ADCC of the protein via improved FcγRIIIa binding without altering antigen binding or CDC activity. Such proteins can be achieved using different methods reported to lead to the successful expression of relatively high defucosylated immunoglobulins bearing the biantennary complex-type of Fc oligosaccharides such as control of culture osmolality (Konno et al., Cytotechnology 64(:249-65, 2012), application of a variant CHO line Lec13 as the host cell line (Shields et al., J Biol Chem 277:26733-26740, 2002), application of a variant CHO line EB66 as the host cell line (Olivier et al., MAbs; 2(4): 405-415, 2010; PMID:20562582), application of a rat hybridoma cell line YB2/0 as the host cell line (Shinkawa et al., *J Biol Chem* 278:3466-3473, 2003), introduction of small interfering RNA specifically against the a 1,6-fucosyltrasferase (FUT8) gene (Mori et al., *Biotechnol Bioeng* 88:901-908, 2004), or coexpression of β-1,4-N-acetylglucosaminyltransferase III and Golgi α-mannosidase II or a potent alpha-mannosidase I inhibitor, kifunensine (Ferrara et al., *J Biol Chem* 281: 5032-5036, 2006, Ferrara et al., *Biotechnol Bioeng* 93:851-861, 2006; Xhou et al., *Biotechnol Bioeng* 99:652-65, 2008).

In some embodiments, the antigen binding domain that binds HLA-G conjugated to the Ig constant region or to the fragment of the Ig constant region of the disclosure has a biantennary glycan structure with fucose content of about between 1% to about 15%, for example about 15%, 14%, 13%, 12%, 11% 10%, 9%, 8%, 7%, 6%, 5%, 4%, 3%, 2% or 1%. In some embodiments, the antigen binding domain that binds HLA-G conjugated to the Ig constant region or to the fragment of the Ig constant region has a glycan structure with fucose content of about 50%, 40%, 45%, 40%, 35%, 30%, 25%, or 20%.

"Fucose content" means the amount of the fucose monosaccharide within the sugar chain at Asn297. The relative amount of fucose is the percentage of fucose-containing structures related to all glycostructures. These may be characterized and quantified by multiple methods, for example: 1) using MALDI-TOF of N-glycosidase F treated sample (e.g. complex, hybrid and oligo- and high-mannose structures) as described in Int Pat. Publ. No. WO2008/0775462); 2) by enzymatic release of the Asn297 glycans with subsequent derivatization and detection/quantitation by HPLC (UPLC) with fluorescence detection and/or HPLC-MS (UPLC-MS); 3) intact protein analysis of the native or reduced mAb, with or without treatment of the Asn297 glycans with Endo S or other enzyme that cleaves between the first and the second GlcNAc monosaccharides, leaving the fucose attached to the first GlcNAc; 4) digestion of the mAb to constituent peptides by enzymatic digestion (e.g., trypsin or endopeptidase Lys-C), and subsequent separation, detection and quantitation by HPLC-MS (UPLC-MS); 5) Separation of the mAb oligosaccharides from the mAb protein by specific enzymatic deglycosylation with PNGase F at Asn 297. The oligosaccharides thus released can be labeled with a fluorophore, separated and identified by various complementary techniques which allow: fine characterization of the glycan structures by matrix-assisted laser desorption ionization (MALDI) mass spectrometry by comparison of the experimental masses with the theoretical masses, determination of the degree of sialylation by ion exchange HPLC (GlycoSep C), separation and quantification of the oligosaccharide forms according to hydrophilicity criteria by normal-phase HPLC (GlycoSep N), and separation and quantification of the oligosaccharides by high performance capillary electrophoresis-laser induced fluorescence (HPCE-LIF).

"Low fucose" or "low fucose content" as used herein refers to the antigen binding domain that bind HLA-G conjugated to the Ig constant region or to the fragment of the Ig constant region with fucose content of about between 1%-15%.

"Normal fucose" or 'normal fucose content" as used herein refers to the antigen binding domain that bind HLA-G conjugated to the Ig constant region or to the fragment of the Ig constant region with fucose content of about over 50%, typically about over 80% or over 85%.

Anti-Idiotypic Antibodies

Anti-idiotypic antibodies are antibodies that specifically bind to the antigen binding domain that binds HLA-G of the disclosure.

The invention also provides an anti-idiotypic antibody that specifically binds to the antigen binding domain that binds HLA-G of the disclosure.

The invention also provides an anti-idiotypic antibody that specifically binds to the antigen binding domain that binds HLA-G comprising the VH of SEQ ID NO: 50 and the VL of SEQ ID NO: 51;
the VH of SEQ ID NO: 52 and the VL of SEQ ID NO: 53;
the VH of SEQ ID NO: 54 and the VL of SEQ ID NO: 55;
the VH of SEQ ID NO: 56 and the VL of SEQ ID NO: 57;
the VH of SEQ ID NO: 58 and the VL of SEQ ID NO: 59;
the VH of SEQ ID NO: 60 and the VL of SEQ ID NO: 61;
the VH of SEQ ID NO: 62 and the VL of SEQ ID NO: 63;
the VH of SEQ ID NO: 64 and the VL of SEQ ID NO: 65;
the VH of SEQ ID NO: 66 and the VL of SEQ ID NO: 67;
or
the VH of SEQ ID NO: 68 and the VL of SEQ ID NO: 69.

An anti-idiotypic (Id) antibody is an antibody which recognizes the antigenic determinants (e.g. the paratope or CDRs) of the antibody. The Id antibody may be antigen-blocking or non-blocking. The antigen-blocking Id may be used to detect the free antigen binding domain in a sample (e.g. the antigen binding domain that binds HLA-G of the disclosure). The non-blocking Id may be used to detect the total antibody (free, partially bond to antigen, or fully bound to antigen) in a sample. An Id antibody may be prepared by immunizing an animal with the antibody to which an anti-Id is being prepared.

An anti-Id antibody may also be used as an immunogen to induce an immune response in yet another animal, producing a so-called anti-anti-Id antibody. An anti-anti-Id may be epitopically identical to the original antigen binding domain which induced the anti-Id. Thus, by using antibodies to the idiotypic determinants of the antigen binding domain, it is possible to identify other clones expressing antigen binding domains of identical specificity. Anti-Id antibodies may be varied (thereby producing anti-Id antibody variants) and/or derivatized by any suitable technique, such as those described elsewhere herein.

Immunoconjugates

The antigen binding domains that bind HLA-G of the disclosure, the proteins comprising the antigen binding domains that bind HLA-G or the multispecific proteins that comprise the antigen binding domains that bind HLA-G (collectively referred herein as to HLA-G binding proteins) may be conjugated to a heterologous molecule.

In some embodiments, the heterologous molecule is a detectable label or a cytotoxic agent.

The invention also provides an antigen binding domain that binds HLA-G conjugated to a detectable label.

The invention also provides a protein comprising an antigen binding domain that binds HLA-G conjugated to a detectable label.

The invention also provides a multispecific protein comprising an antigen binding domain that binds HLA-G conjugated to a detectable label.

The invention also provides an antigen binding domain that binds HLA-G conjugated to a cytotoxic agent.

The invention also provides a protein comprising an antigen binding domain that binds HLA-G conjugated to a cytotoxic agent.

The invention also provides a multispecific protein comprising an antigen binding domain that binds HLA-G conjugated to a cytotoxic agent.

HLA-G binding proteins of the disclosure may be used to direct therapeutics to HLA-G expressing cells. such as prostate or breast cancer cells. Alternatively, HLA-G expressing cells may be targeted with a HLA-G binding protein of the disclosure coupled to a therapeutic intended to modify cell function once internalized.

In some embodiments, the detectable label is also a cytotoxic agent.

The HLA-G binding proteins of the disclosure conjugated to a detectable label may be used to evaluate expression of HLA-G on a variety of samples.

Detectable label includes compositions that when conjugated to the HLA-G binding proteins of the disclosure renders the latter detectable, via spectroscopic, photochemical, biochemical, immunochemical, or chemical means.

Exemplary detectable labels include radioactive isotopes, magnetic beads, metallic beads, colloidal particles, fluorescent dyes, electron-dense reagents, enzymes (for example, as commonly used in an ELISA), biotin, digoxigenin, haptens, luminescent molecules, chemiluminescent molecules, fluorochromes, fluorophores, fluorescent quenching agents, colored molecules, radioactive isotopes, scintillates, avidin, streptavidin, protein A, protein G, antibodies or fragments thereof, polyhistidine, $Ni^{2+}$, Flag tags, myc tags, heavy metals, enzymes, alkaline phosphatase, peroxidase, luciferase, electron donors/acceptors, acridinium esters, and colorimetric substrates.

A detectable label may emit a signal spontaneously, such as when the detectable label is a radioactive isotope. In other cases, the detectable label emits a signal as a result of being stimulated by an external field.

Exemplary radioactive isotopes may be γ-emitting, Auger-emitting, β-emitting, an alpha-emitting or positron-emitting radioactive isotope. Exemplary radioactive isotopes include $^{3}H$, $^{11}C$, $^{13}C$, $^{15}N$, $^{18}F$, $^{19}F$, $^{55}Co$, $^{57}Co$, $^{60}Co$, $^{61}Cu$, $^{62}Cu$, $^{64}Cu$, $^{67}Cu$, $^{68}Ga$, $^{72}As$, $^{75}Br$, $^{86}Y$, $^{89}Zr$, $^{90}Sr$, $^{94m}Tc$, $^{99m}Tc$, $^{115}In$, $^{123}I$, $^{124}I$, $^{125}I$, $^{131}I$, $^{211}At$, $^{212}Bi$, $^{213}Bi$, $^{223}Ra$, $^{226}Ra$, $^{225}Ac$ and $^{227}Ac$.

Exemplary metal atoms are metals with an atomic number greater than 20, such as calcium atoms, scandium atoms, titanium atoms, vanadium atoms, chromium atoms, manganese atoms, iron atoms, cobalt atoms, nickel atoms, copper atoms, zinc atoms, gallium atoms, germanium atoms, arsenic atoms, selenium atoms, bromine atoms, krypton atoms, rubidium atoms, strontium atoms, yttrium atoms, zirconium atoms, niobium atoms, molybdenum atoms, technetium atoms, ruthenium atoms, rhodium atoms, palladium atoms, silver atoms, cadmium atoms, indium atoms, tin atoms, antimony atoms, tellurium atoms, iodine atoms, xenon atoms, cesium atoms, barium atoms, lanthanum atoms, hafnium atoms, tantalum atoms, tungsten atoms, rhenium atoms, osmium atoms, iridium atoms, platinum atoms, gold atoms, mercury atoms, thallium atoms, lead atoms, bismuth atoms, francium atoms, radium atoms, actinium atoms, cerium atoms, praseodymium atoms, neodymium atoms, promethium atoms, samarium atoms, europium atoms, gadolinium atoms, terbium atoms, dysprosium atoms, holmium atoms, erbium atoms, thulium atoms, ytterbium atoms, lutetium atoms, thorium atoms, protactinium atoms, uranium atoms, neptunium atoms, plutonium atoms, americium atoms, curium atoms, berkelium atoms, californium atoms, einsteinium atoms, fermium atoms, mendelevium atoms, nobelium atoms, or lawrencium atoms.

In some embodiments, the metal atoms may be alkaline earth metals with an atomic number greater than twenty.

In some embodiments, the metal atoms may be lanthanides.

In some embodiments, the metal atoms may be actinides.

In some embodiments, the metal atoms may be transition metals.

In some embodiments, the metal atoms may be poor metals.

In some embodiments, the metal atoms may be gold atoms, bismuth atoms, tantalum atoms, and gadolinium atoms.

In some embodiments, the metal atoms may be metals with an atomic number of 53 (i.e. iodine) to 83 (i.e. bismuth).

In some embodiments, the metal atoms may be atoms suitable for magnetic resonance imaging.

The metal atoms may be metal ions in the form of +1, +2, or +3 oxidation states, such as $Ba^{2+}$, $Bi^{3+}$, $Cs^{+}$, $Ca^{2+}$, $Cr^{2+}$, $Cr^{3+}$, $Cr^{6+}$, $Co^{2+}$, $Co^{3+}$, $Cu^{+}$, $Cu^{2+}$, $Cu^{3+}$, $Ga^{3+}$, $Gd^{3+}$, $Au^{+}$, $Au^{3+}$, $Fe^{2+}$, $Fe^{3+}$, $F^{3+}$, $Pb^{2+}$, $Mn^{2+}$, $Mn^{3+}$, $Mn^{4+}$, $Mn^{7+}$, $Hg^{2+}$, $Ni^{2+}$, $Ni^{3+}$, $Ag^{+}$, $Sr^{2+}$, $Sn^{2+}$, $Sn^{4+}$, and $Zn^{2+}$. The metal atoms may comprise a metal oxide, such as iron oxide, manganese oxide, or gadolinium oxide.

Suitable dyes include any commercially available dyes such as, for example, 5(6)-carboxyfluorescein, IRDye 680RD maleimide or IRDye 800CW, ruthenium polypyridyl dyes, and the like.

Suitable fluorophores are fluorescein isothiocyanate (FITC), fluorescein thiosemicarbazide, rhodamine, Texas Red, CyDyes (e.g., Cy3, Cy5, Cy5.5), Alexa Fluors (e.g., Alexa488, Alexa555, Alexa594; Alexa647), near infrared (NIR) (700-900 nm) fluorescent dyes, and carbocyanine and aminostyryl dyes.

The antigen binding domain that binds HLA-G conjugated to a detectable label may be used as an imaging agent.

The protein comprising an antigen binding domain that binds HLA-G conjugated to a detectable label may be used as an imaging agent.

The multispecific protein comprising an antigen binding domain that binds HLA-G conjugated to a detectable label may be used as an imaging agent.

In some embodiments, the cytotoxic agent is a chemotherapeutic agent, a drug, a growth inhibitory agent, a toxin (e.g., an enzymatically active toxin of bacterial, fungal, plant, or animal origin, or fragments thereof), or a radioactive isotope (i.e., a radioconjugate).

In some embodiments, the cytotoxic agent is daunomycin, doxorubicin, methotrexate, vindesine, bacterial toxins such as diphtheria toxin, ricin, geldanamycin, maytansinoids or calicheamicin. The cytotoxic agent may elicit their cytotoxic and cytostatic effects by mechanisms including tubulin binding, DNA binding, or topoisomerase inhibition.

In some embodiments, the cytotoxic agent is an enzymatically active toxin such as diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In some embodiments, the cytotoxic agent is a radionuclide, such as $^{212}Bi$, $^{131}I$, $^{131}In$, $^{90}Y$, and $^{186}Re$.

In some embodiments, the cytotoxic agent is dolastatins or dolostatin peptidic analogs and derivatives, auristatin or monomethyl auristatin phenylalanine Exemplary molecules are disclosed in U.S. Pat. Nos. 5,635,483 and 5,780,588. Dolastatins and auristatins have been shown to interfere with microtubule dynamics, GTP hydrolysis, and nuclear and cellular division (Woyke et al (2001) Antimicrob Agents and Chemother. 45(12):3580-3584) and have anticancer and antifungal activity. The dolastatin or auristatin drug moiety may be attached to the antibody of the invention through the N (amino) terminus or the C (carboxyl) terminus of the peptidic drug moiety (WO02/088172), or via any cysteine engineered into the antibody.

The HLA-G binding proteins of the disclosure may be conjugated to a detectable label using known methods.

In some embodiments, the detectable label is complexed with a chelating agent.

In some embodiments, the detectable label is conjugated to the HLA-G binding proteins of the disclosure via a linker.

The detectable label or the cytotoxic moiety may be linked directly, or indirectly, to the HLA-G binding proteins of the disclosure using known methods. Suitable linkers are known in the art and include, for example, prosthetic groups, non-phenolic linkers (derivatives of N-succimidyl-benzoates; dodecaborate), chelating moieties of both macrocyclics and acyclic chelators, such as derivatives of 1,4,7,10-tetraazacyclododecane-1,4,7,10,tetraacetic acid (DOTA), derivatives of diethylenetriaminepentaacetic avid (DTPA), derivatives of S-2-(4-Isothiocyanatobenzyl)-1,4,7-triazacyclononane-1,4,7-triacetic acid (NOTA) and derivatives of 1,4,8,11-tetraazacyclodocedan-1,4,8,11-tetraacetic acid (TETA), N-succinimidyl-3-(2-pyridyldithiol) propionate (SPDP), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene) and other chelating moieties. Suitable peptide linkers are well known.

In some embodiments, the HLA-G binding proteins of the disclosure is removed from the blood via renal clearance.

Kits

The invention also provides a kit comprising the antigen binding domain that binds HLA-G.

The invention also provides a kit comprising the protein comprising an antigen binding domain that binds HLA-G.

The invention also provides a kit comprising the multispecific protein comprising an antigen binding domain that binds HLA-G.

The kit may be used for therapeutic uses and as diagnostic kits.

The kit may be used to detect the presence of HLA-G in a sample.

In some embodiments, the kit comprises the HLA-G binding protein of the disclosure and reagents for detecting the HLA-G binding protein. The kit can include one or more other elements including: instructions for use; other reagents, e.g., a label, a therapeutic agent, or an agent useful for chelating, or otherwise coupling, an antibody to a label or therapeutic agent, or a radioprotective composition; devices or other materials for preparing the antibody for administration; pharmaceutically acceptable carriers; and devices or other materials for administration to a subject.

In some embodiments, the kit comprises the antigen binding domain that binds HLA-G in a container and instructions for use of the kit.

In some embodiments, the kit comprises the protein comprising an antigen binding domain that binds HLA-G in a container and instructions for use of the kit.

In some embodiments, the kit comprises the multispecific protein comprising an antigen binding domain that binds HLA-G in a container and instructions for use of the kit.

In some embodiments, the antigen binding domain that binds HLA-G in the kit is labeled.

In some embodiments, the protein comprising an antigen binding domain that binds HLA-G in the kit is labeled.

In some embodiments, the multispecific protein comprising an antigen binding domain that binds HLA-G in the kit is labeled.

In some embodiments, the kit comprises the antigen binding domain that binds HLA-G comprising
the VH of SEQ ID NO: 50 and the VL of SEQ ID NO: 51;
the VH of SEQ ID NO: 52 and the VL of SEQ ID NO: 53;
the VH of SEQ ID NO: 54 and the VL of SEQ ID NO: 55;
the VH of SEQ ID NO: 56 and the VL of SEQ ID NO: 57;
the VH of SEQ ID NO: 58 and the VL of SEQ ID NO: 59;
the VH of SEQ ID NO: 60 and the VL of SEQ ID NO: 61;
the VH of SEQ ID NO: 62 and the VL of SEQ ID NO: 63;
the VH of SEQ ID NO: 64 and the VL of SEQ ID NO: 65;
the VH of SEQ ID NO: 66 and the VL of SEQ ID NO: 67; or
the VH of SEQ ID NO: 68 and the VL of SEQ ID NO: 69.

In some embodiments, the kit comprises the antigen binding domain that binds HLA-G comprising SEQ ID NOs: 248, 249, 250, 251, 252, 253, 254, 255, 256, 257, 258, 259, 260, 261, 262, 263, 264, 265, 266, 267, 268, or 269.

Methods of Detecting HLA-G

The invention also provides a method of detecting HLA-G in a sample, comprising obtaining the sample, contacting the sample with the antigen binding domain that binds HLA-G of the disclosure and detecting the bound HLA-G in the sample.

In some embodiments, the sample may be derived from urine, blood, serum, plasma, saliva, ascites, circulating cells, synovial fluid, circulating cells, cells that are not tissue associated (i.e., free cells), tissues (e.g., surgically resected tissue, biopsies, including fine needle aspiration), histological preparations, and the like.

The antigen binding domain that binds HLA-G of the disclosure may be detected using known methods. Exemplary methods include direct labeling of the antibodies using fluorescent or chemiluminescent labels, or radiolabels, or attaching to the antibodies of the invention a moiety which is readily detectable, such as biotin, enzymes or epitope tags. Exemplary labels and moieties are ruthenium, $^{111}$In-DOTA, diethylenetriaminepentaacetic acid (DTPA), horseradish peroxidase, alkaline phosphatase and beta-galactosidase, poly-histidine (HIS tag), acridine dyes, cyanine dyes, fluorone dyes, oxazin dyes, phenanthridine dyes, rhodamine dyes and Alexafluor® dyes.

The antigen binding domain that binds HLA-G of the disclosure may be used in a variety of assays to detect HLA-G in the sample. Exemplary assays are western blot analysis, radioimmunoassay, surface plasmon resonance, immunoprecipitation, equilibrium dialysis, immunodiffusion, electrochemiluminescence (ECL) immunoassay, immunohistochemistry, fluorescence-activated cell sorting (FACS) or ELISA assay.

Polynucleotides, Vectors, Host Cells

The disclosure also provides an isolated polynucleotide encoding any of the HLA-G binding proteins of the disclosure. The HLA-G binding protein includes the antigen binding domains that bind HLA-G, the proteins comprising the antigen binding domains that bind HLA-G, the multispecific proteins that comprise the antigen binding domains that bind HLA-G of the disclosure.

The invention also provides an isolated polynucleotide encoding any of HLA-G binding proteins or fragments thereof.

The invention also provides an isolated polynucleotide encoding the VH of SEQ ID NO: 50.

The invention also provides an isolated polynucleotide encoding the VL of SEQ ID NO: 51.

The invention also provides an isolated polynucleotide encoding the VH of SEQ ID NO: 52.

The invention also provides an isolated polynucleotide encoding the VL of SEQ ID NO: 53.

The invention also provides an isolated polynucleotide encoding the VH of SEQ ID NO: 54.

The invention also provides an isolated polynucleotide encoding the VL of SEQ ID NO: 55.

The invention also provides an isolated polynucleotide encoding the VL of SEQ ID NO: 56.

The invention also provides an isolated polynucleotide encoding the VL of SEQ ID NO: 57.

The invention also provides an isolated polynucleotide encoding the VL of SEQ ID NO: 58.

The invention also provides an isolated polynucleotide encoding the VL of SEQ ID NO: 59.

The invention also provides an isolated polynucleotide encoding the VL of SEQ ID NO: 60.

The invention also provides an isolated polynucleotide encoding the VL of SEQ ID NO: 61.

The invention also provides an isolated polynucleotide encoding the VL of SEQ ID NO: 62.

The invention also provides an isolated polynucleotide encoding the VL of SEQ ID NO: 63.

The invention also provides an isolated polynucleotide encoding the VL of SEQ ID NO: 64.

The invention also provides an isolated polynucleotide encoding the VL of SEQ ID NO: 65.

The invention also provides an isolated polynucleotide encoding the VL of SEQ ID NO: 66.

The invention also provides an isolated polynucleotide encoding the VL of SEQ ID NO: 67.

The invention also provides an isolated polynucleotide encoding the VL of SEQ ID NO: 68.

The invention also provides an isolated polynucleotide encoding the VL of SEQ ID NO: 69.

The invention also provides an isolated polynucleotide encoding the VH of SEQ ID NOs: 50, 52, 54, 56, 58, 60, 62, 64, 66, or 68.

The invention also provides an isolated polynucleotide encoding the VL of SEQ ID NOs: 51, 53, 55, 57, 59, 61, 63, 65, 67, or 69.

The invention also provides an isolated polynucleotide encoding the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

The invention also provides for an isolated polynucleotide encoding
  the VH of SEQ ID NO: 50 and the VL of SEQ ID NO: 51;
  the VH of SEQ ID NO: 52 and the VL of SEQ ID NO: 53;
  the VH of SEQ ID NO: 54 and the VL of SEQ ID NO: 55;
  the VH of SEQ ID NO: 56 and the VL of SEQ ID NO: 57;
  the VH of SEQ ID NO: 58 and the VL of SEQ ID NO: 59;
  the VH of SEQ ID NO: 60 and the VL of SEQ ID NO: 61;
  the VH of SEQ ID NO: 62 and the VL of SEQ ID NO: 63;
  the VH of SEQ ID NO: 64 and the VL of SEQ ID NO: 65;
  the VH of SEQ ID NO: 66 and the VL of SEQ ID NO: 67; or
  the VH of SEQ ID NO: 68 and the VL of SEQ ID NO: 69.

The invention also provides an isolated polynucleotide encoding the polypeptide of SEQ ID NOs: SEQ ID NOs: 248, 249, 250, 251, 252, 253, 254, 255, 256, 257, 258, 259, 260, 261, 262, 263, 264, 265, 266, 267, 268, or 269.

The invention also provides an isolated polynucleotide encoding the polypeptide of SEQ ID NO: 248.

The invention also provides an isolated polynucleotide encoding the polypeptide of SEQ ID NO: 249.

The invention also provides an isolated polynucleotide encoding the polypeptide of SEQ ID NO: 250.

The invention also provides an isolated polynucleotide encoding the polypeptide of SEQ ID NO: 251.

The invention also provides an isolated polynucleotide encoding the polypeptide of SEQ ID NO:

The invention also provides an isolated polynucleotide encoding the polypeptide of SEQ ID NO: 253.

The invention also provides an isolated polynucleotide encoding the polypeptide of SEQ ID NO: 254.

The invention also provides an isolated polynucleotide encoding the polypeptide of SEQ ID NO: 255.

The invention also provides an isolated polynucleotide encoding the polypeptide of SEQ ID NO: 256.

The invention also provides an isolated polynucleotide encoding the polypeptide of SEQ ID NO: 257.

The invention also provides an isolated polynucleotide encoding the polypeptide of SEQ ID NO: 258.

The invention also provides an isolated polynucleotide encoding the polypeptide of SEQ ID NO: 259.

The invention also provides an isolated polynucleotide encoding the polypeptide of SEQ ID NO: 260.

The invention also provides an isolated polynucleotide encoding the polypeptide of SEQ ID NO: 261.

The invention also provides an isolated polynucleotide encoding the polypeptide of SEQ ID NO: 262.

The invention also provides an isolated polynucleotide encoding the polypeptide of SEQ ID NO: 263.

The invention also provides an isolated polynucleotide encoding the polypeptide of SEQ ID NO: 264.

The invention also provides an isolated polynucleotide encoding the polypeptide of SEQ ID NO: 265.

The invention also provides an isolated polynucleotide encoding the polypeptide of SEQ ID NO: 266.

The invention also provides an isolated polynucleotide encoding the polypeptide of SEQ ID NO: 267.

The invention also provides an isolated polynucleotide encoding the polypeptide of SEQ ID NO: 268.

The invention also provides an isolated polynucleotide encoding the polypeptide of SEQ ID NO:

Some embodiments of the disclosure also provide an isolated or purified nucleic acid comprising a polynucleotide which is complementary to the polynucleotides encoding the HLA-G binding proteins of the disclosure or polynucleotides which hybridize under stringent conditions to the polynucleotides encoding the HLA-G binding proteins of the disclosure.

The polynucleotides which hybridize under stringent conditions may hybridize under high stringency conditions. By "high stringency conditions" is meant that the polynucleotide specifically hybridizes to a target sequence (the nucleotide sequence of any of the nucleic acids described herein) in an amount that is detectably stronger than nonspecific hybridization. High stringency conditions include conditions which would distinguish a polynucleotide with an exact complementary sequence, or one containing only a few scattered mismatches from a random sequence that happened to have a few small regions (e.g., 3-12 bases) that matched the nucleotide sequence. Such small regions of complementarity are more easily melted than a full-length complement of 14-17 or more bases, and high stringency hybridization makes them easily distinguishable. Relatively high stringency conditions would include, for example, low salt and/or high temperature conditions, such as provided by about 0.02-0.1 M NaCl or the equivalent, at temperatures of about 50-70° C. Such high stringency conditions tolerate little, if any, mismatch between the nucleotide sequence and the template or target strand. It is generally appreciated that conditions can be rendered more stringent by the addition of increasing amounts of formamide.

The polynucleotide sequences of the disclosure may be operably linked to one or more regulatory elements, such as a promoter or enhancer, that allow expression of the nucleotide sequence in the intended host cell. The polynucleotide may be a cDNA. The promoter bay be a strong, weak, tissue-specific, inducible or developmental-specific promoter. Exemplary promoters that may be used are hypoxanthine phosphoribosyl transferase (HPRT), adenosine deaminase, pyruvate kinase, beta-actin, human myosin, human hemoglobin, human muscle creatine, and others. In addition, many viral promoters function constitutively in eukaryotic cells and are suitable for use with the described embodiments. Such viral promoters include Cytomegalovirus (CMV) immediate early promoter, the early and late promoters of SV40, the Mouse Mammary Tumor Virus (MMTV) promoter, the long terminal repeats (LTRs) of Maloney leukemia virus, Human Immunodeficiency Virus (HIV), Epstein Barr Virus (EBV), Rous Sarcoma Virus (RSV), and other retroviruses, and the thymidine kinase promoter of Herpes Simplex Virus. Inducible promoters such as the metallothionein promoter, tetracycline-inducible promoter, doxycycline-inducible promoter, promoters that contain one or more interferon-stimulated response elements (ISRE) such as protein kinase R 2',5'-oligoadenylate synthetases, Mx genes, ADAR1, and the like may also be sued.

The invention also provides a vector comprising the polynucleotide of the invention. The disclosure also provide an expression vector comprising the polynucleotide of the invention. Such vectors may be plasmid vectors, viral vectors, vectors for baculovirus expression, transposon based vectors or any other vector suitable for introduction of the synthetic polynucleotide of the invention into a given organism or genetic background by any means. Polynucleotides encoding the HLA-G binding proteins of the disclosure may be operably linked to control sequences in the expression vector(s) that ensure the expression of the HLA-G binding proteins. Such regulatory elements may include a transcriptional promoter, sequences encoding suitable mRNA ribosomal binding sites, and sequences that control the termination of transcription and translation. Expression vectors may also include one or more nontranscribed elements such as an origin of replication, a suitable promoter and enhancer linked to the gene to be expressed, other 5' or 3' flanking nontranscribed sequences, 5' or 3' nontranslated sequences (such as necessary ribosome binding sites), a polyadenylation site, splice donor and acceptor sites, or transcriptional termination sequences. An origin of replication that confers the ability to replicate in a host may also be incorporated.

The expression vectors can comprise naturally-occurring or non-naturally-occurring internucleotide linkages, or both types of linkages. The non-naturally occurring or altered nucleotides or internucleotide linkages do not hinder the transcription or replication of the vector.

Once the vector has been incorporated into the appropriate host, the host is maintained under conditions suitable for high level expression of the HLA-G binding proteins of the disclosure encoded by the incorporated polynucleotides. The transcriptional and translational control sequences in expression vectors to be used in transforming vertebrate cells may be provided by viral sources. Exemplary vectors may be constructed as described by Okayama and Berg, 3 *Mol. Cell. Biol.* 280 (1983).

Vectors of the disclosure may also contain one or more Internal Ribosome Entry Site(s) (IRES). Inclusion of an IRES sequence into fusion vectors may be beneficial for enhancing expression of some proteins. In some embodiments, the vector system will include one or more polyadenylation sites (e.g., SV40), which may be upstream or downstream of any of the aforementioned nucleic acid sequences. Vector components may be contiguously linked or arranged in a manner that provides optimal spacing for expressing the gene products (i.e., by the introduction of "spacer" nucleotides between the ORFs) or positioned in another way. Regulatory elements, such as the IRES motif, may also be arranged to provide optimal spacing for expression.

Vectors of the disclosure may be circular or linear. They may be prepared to contain a replication system functional in a prokaryotic or eukaryotic host cell. Replication systems can be derived, e.g., from ColE1, SV40, 2μ plasmid, λ, bovine papilloma virus, and the like.

The recombinant expression vectors can be designed for either transient expression, for stable expression, or for both. Also, the recombinant expression vectors can be made for constitutive expression or for inducible expression.

Further, the recombinant expression vectors can be made to include a suicide gene. As used herein, the term "suicide gene" refers to a gene that causes the cell expressing the suicide gene to die. The suicide gene can be a gene that confers sensitivity to an agent, e.g., a drug, upon the cell in which the gene is expressed, and causes the cell to die when the cell is contacted with or exposed to the agent. Suicide genes are known in the art and include, for example, the Herpes Simplex Virus (HSV) thymidine kinase (TK) gene, cytosine deaminase, purine nucleoside phosphorylase, and nitroreductase.

The vectors may also comprise selection markers, which are well known in the art. Selection markers include positive and negative selection marker. Marker genes include biocide resistance, e.g., resistance to antibiotics, heavy metals, etc., complementation in an auxotrophic host to provide prototrophy, and the like. Exemplary marker genes include antibiotic resistance genes (e.g., neomycin resistance gene, a hygromycin resistance gene, a kanamycin resistance gene, a tetracycline resistance gene, a penicillin resistance gene, histidinol resistance gene, histidinol x resistance gene), glutamine synthase genes, HSV-TK, HSV-TK derivatives for ganciclovir selection, or bacterial purine nucleoside phosphorylase gene for 6-methylpurine selection (Gadi et al., 7 *Gene Ther.* 1738-1743 (2000)). A nucleic acid sequence encoding a selection marker or the cloning site may be upstream or downstream of a nucleic acid sequence encoding a polypeptide of interest or cloning site.

Exemplary vectors that may be used are Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWLneo, pSV2cat, pOG44, PXR1, pSG (Stratagene) pSVK3, pBPV, pMSG and pSVL (Pharmacia), pEE6.4 (Lonza) and pEE12.4 (Lonza). Additional vectors include the pUC series (Fermentas Life Sciences, Glen Burnie, Md.), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGT10, λGT11, λEMBL4, and λNM1149, λZapII (Stratagene) can be used. Exemplary plant expression vectors include pBI01, pBI01.2, pBI121, pBI101.3, and pBIN19 (Clontech). Exemplary animal expression vectors include pEUK-Cl, pMAM, and pMAMneo (Clontech). The expression vector may be a viral vector, e.g., a retroviral vector, e.g., a gamma retroviral vector.

In some embodiments, the vector comprises the polynucleotide encoding the VH of SEQ ID NO: 50.

In some embodiments, the vector comprises the polynucleotide encoding the VL of SEQ ID NO: 51.

In some embodiments, the vector comprises the polynucleotide encoding the VH of SEQ ID NO:

In some embodiments, the vector comprises the polynucleotide encoding the VL of SEQ ID NO: 53.

In some embodiments, the vector comprises the polynucleotide encoding the VH of SEQ ID NO: 54.

In some embodiments, the vector comprises the polynucleotide encoding the VL of SEQ ID NO: 55.

In some embodiments, the vector comprises the polynucleotide encoding the VL of SEQ ID NO: 56.

In some embodiments, the vector comprises the polynucleotide encoding the VL of SEQ ID NO: 57.

In some embodiments, the vector comprises the polynucleotide encoding the VL of SEQ ID NO: 58.

In some embodiments, the vector comprises the polynucleotide encoding the VL of SEQ ID NO: 59.

In some embodiments, the vector comprises the polynucleotide encoding the VL of SEQ ID NO: 60.

In some embodiments, the vector comprises the polynucleotide encoding the VL of SEQ ID NO: 61.

In some embodiments, the vector comprises the polynucleotide encoding the VL of SEQ ID NO: 62.

In some embodiments, the vector comprises the polynucleotide encoding the VL of SEQ ID NO: 63.

In some embodiments, the vector comprises the polynucleotide encoding the VL of SEQ ID NO: 64.

In some embodiments, the vector comprises the polynucleotide encoding the VL of SEQ ID NO: 65.

In some embodiments, the vector comprises the polynucleotide encoding the VL of SEQ ID NO: 66.

In some embodiments, the vector comprises the polynucleotide encoding the VL of SEQ ID NO: 67.

In some embodiments, the vector comprises the polynucleotide encoding the VL of SEQ ID NO: 68.

In some embodiments, the vector comprises the polynucleotide encoding the VL of SEQ ID NO:

In some embodiments, the vector comprises the polynucleotide encoding VH of SEQ ID NOs: 50, 52, 54, 56, 58, 60, 62, 64, 66, or 68.

In some embodiments, the vector comprises the polynucleotide encoding the VL of SEQ ID NOs: 51, 53, 55, 57, 59, 61, 63, 65, 67, or 69.

In some embodiments, the vector comprises the polynucleotide encoding the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

In some embodiments, the vector comprises the polynucleotide encoding
the VH of SEQ ID NO: 50 and the VL of SEQ ID NO: 51;
the VH of SEQ ID NO: 52 and the VL of SEQ ID NO: 53;
the VH of SEQ ID NO: 54 and the VL of SEQ ID NO: 55;
the VH of SEQ ID NO: 56 and the VL of SEQ ID NO: 57;
the VH of SEQ ID NO: 58 and the VL of SEQ ID NO: 59;
the VH of SEQ ID NO: 60 and the VL of SEQ ID NO: 61;
the VH of SEQ ID NO: 62 and the VL of SEQ ID NO: 63;
the VH of SEQ ID NO: 64 and the VL of SEQ ID NO: 65;
the VH of SEQ ID NO: 66 and the VL of SEQ ID NO: 67;
or
the VH of SEQ ID NO: 68 and the VL of SEQ ID NO: 69.

In some embodiments, the vector comprises the polynucleotide encoding polypeptide of SEQ ID NOs: SEQ ID NOs: 248, 249, 250, 251, 252, 253, 254, 255, 256, 257, 258, 259, 260, 261, 262, 263, 264, 265, 266, 267, 268, or 269.

In some embodiments, the vector comprises the polynucleotide encoding the polypeptide of SEQ ID NO: 248.

In some embodiments, the vector comprises the polynucleotide encoding the polypeptide of SEQ ID NO: 249.

In some embodiments, the vector comprises the polynucleotide encoding the polypeptide of SEQ ID NO: 250.

In some embodiments, the vector comprises the polynucleotide encoding the polypeptide of SEQ ID NO: 251.

In some embodiments, the vector comprises the polynucleotide encoding the polypeptide of SEQ ID NO: 252.

In some embodiments, the vector comprises the polynucleotide encoding the polypeptide of SEQ ID NO: 253.

In some embodiments, the vector comprises the polynucleotide encoding the polypeptide of SEQ ID NO: 254.

In some embodiments, the vector comprises the polynucleotide encoding the polypeptide of SEQ ID NO: 255.

In some embodiments, the vector comprises the polynucleotide encoding the polypeptide of SEQ ID NO: 256.

In some embodiments, the vector comprises the polynucleotide encoding the polypeptide of SEQ ID NO: 257.

In some embodiments, the vector comprises the polynucleotide encoding the polypeptide of SEQ ID NO: 258.

In some embodiments, the vector comprises the polynucleotide encoding the polypeptide of SEQ ID NO: 259.

In some embodiments, the vector comprises the polynucleotide encoding the polypeptide of SEQ ID NO: 260.

In some embodiments, the vector comprises the polynucleotide encoding the polypeptide of SEQ ID NO: 261.

In some embodiments, the vector comprises the polynucleotide encoding the polypeptide of SEQ ID NO: 262.

In some embodiments, the vector comprises the polynucleotide encoding the polypeptide of SEQ ID NO: 263.

In some embodiments, the vector comprises the polynucleotide encoding the polypeptide of SEQ ID NO: 264.

In some embodiments, the vector comprises the polynucleotide encoding the polypeptide of SEQ ID NO: 265.

In some embodiments, the vector comprises the polynucleotide encoding the polypeptide of SEQ ID NO: 266.

In some embodiments, the vector comprises the polynucleotide encoding the polypeptide of SEQ ID NO: 267.

In some embodiments, the vector comprises the polynucleotide encoding the polypeptide of SEQ ID NO: 268.

In some embodiments, the vector comprises the polynucleotide encoding the polypeptide of SEQ ID NO: 269.

The invention also provides for a host cell comprising one or more vectors of the invention. "Host cell" refers to a cell into which a vector has been introduced. It is understood that the term host cell is intended to refer not only to the particular subject cell but to the progeny of such a cell, and also to a stable cell line generated from the particular subject cell. Because certain modifications may occur in succeeding generations due to either mutation or environmental influences, such progeny may not be identical to the parent cell, but are still included within the scope of the term "host cell" as used herein. Such host cells may be eukaryotic cells, prokaryotic cells, plant cells or archeal cells. *Escherichia* coli, bacilli, such as *Bacillus subtilis*, and other enterobacteriaceae, such as *Salmonella, Serratia*, and various *Pseudomonas* species are examples of prokaryotic host cells. Other microbes, such as yeast, are also useful for expression. *Saccharomyces* (e.g., *S. cerevisiae*) and *Pichia* are examples of suitable yeast host cells. Exemplary eukaryotic cells may be of mammalian, insect, avian or other animal origins. Mammalian eukaryotic cells include immortalized cell lines such as hybridomas or myeloma cell lines such as SP2/0 (American Type Culture Collection (ATCC), Manassas, VA, CRL-1581), NSO (European Collection of Cell Cultures (ECACC), Salisbury, Wiltshire, UK, ECACC No. 85110503), FO (ATCC CRL-1646) and Ag653 (ATCC CRL-1580) murine cell lines. An exemplary human myeloma cell line is U266 (ATTC CRL-TIB-196). Other useful cell lines include those derived from Chinese Hamster Ovary (CHO) cells such as CHO-K1SV (Lonza Biologics, Walkersville, MD), CHO-K1 (ATCC CRL-61) or DG44.

The disclosure also provides a method of producing the HLA-G binding protein of the disclosure comprising culturing the host cell of the disclosure in conditions that the K2 binding protein is expressed, and recovering the HLA-G binding protein produced by the host cell. Methods of making proteins and purifying them are known. Once synthesized (either chemically or recombinantly), the HLA-G binding proteins may be purified according to standard procedures, including ammonium sulfate precipitation, affinity columns, column chromatography, high performance liquid chromatography (HPLC) purification, gel electrophoresis, and the like (see generally Scopes, Protein Purification (Springer-Verlag, N.Y., (1982)). A subject protein may be substantially pure, e.g., at least about 80% to 85% pure, at least about 85% to 90% pure, at least about 90% to 95% pure, or at least about 98% to 99%, or more, pure, e.g., free from contaminants such as cell debris, macromolecules, etc. other than the subject protein The polynucleotides encoding the HLA-G binding proteins of the disclosure may be incorporated into vectors using standard molecular biology methods. Host cell transformation, culture, antibody expression and purification are done using well known methods.

Modified nucleotides may be used to generate the polynucleotides of the disclosure. Exemplary modified nucleotides are 5-fluorouracil, 5-bromouracil, 5-chlorouracil, 5-iodouracil, hypoxanthine, xanthine, 4-acetylcytosine, 5-(carboxyhydroxymethyl) uracil, carboxymethylaminomethyl-2-thiouridine, 5-carboxymethylaminomethyluracil, dihydrouracil, $N^6$-substituted adenine, 7-methylguanine, 5-methylaminomethyluracil, 5-me thoxyaminomethyl-2-thiouracil, beta-D-mannosylqueosine, 5"-methoxycarboxymethyluracil, 5-methoxyuracil, 2-methylthio-$N^6$-isopentenyladenine, uracil-5-oxyacetic acid (v), wybutoxosine, pseudouracil, queuosine, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, 2-thiocytosine, 5-methyl-2-thiouracil, 2-thiouracil, 4-thiouracil, 5-methyluracil, uracil-5-oxyacetic acid methylester, 3-β-amino-3-N-2-carboxypropyl) uracil, and 2,6-diaminopurine.

Pharmaceutical Compositions/Administration

The disclosure also provides a pharmaceutical composition comprising the HLA-G binding protein of the disclosure and a pharmaceutically acceptable carrier.

The disclosure also provides a pharmaceutical composition comprising the antigen binding domain that binds HLA-G of the disclosure and a pharmaceutically acceptable carrier.

The disclosure also provides a pharmaceutical composition comprising the protein comprising the antigen binding domain that binds HLA-G of the disclosure and a pharmaceutically acceptable carrier.

The disclosure also provides a pharmaceutical composition comprising the multispecific protein comprising the antigen binding domain that binds HLA-G of the disclosure and a pharmaceutically acceptable carrier.

The disclosure also provides a pharmaceutical composition comprising the multispecific protein comprising the antigen binding domain that binds HLA-G and an antigen binding domain that binds a tumor antigen other than HLA-G and a pharmaceutically acceptable carrier.

The HLA-G binding protein of the disclosure may be prepared as pharmaceutical compositions containing an effective amount of the antibody as an active ingredient in a pharmaceutically acceptable carrier. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc. The term "pharmaceutically acceptable," as used herein with regard to pharmaceutical compositions, means approved by a regulatory agency of the Federal or a state government or listed in the U.S. Pharmacopeia or other generally recognized pharmacopeia for use in animals and/or in humans.

Methods of Treatment and Uses

The disclosure also provides the bispecific or multispecific protein comprising a first antigen binding domain that specifically binds HLA-G and a second antigen binding domain that specifically binds a second antigen of the disclosure for use in therapy.

The disclosure also provides the bispecific or multispecific protein comprising a first antigen binding domain that specifically binds HLA-G and a second antigen binding domain that specifically binds a second antigen of the disclosure for use in treating a cell proliferative disorder.

The disclosure also provides the bispecific or multispecific protein comprising a first antigen binding domain that specifically binds HLA-G and a second antigen binding domain that specifically binds a second antigen of the disclosure for use in treating cancer.

The disclosure also provides the bispecific or multispecific protein comprising a first antigen binding domain that specifically binds HLA-G and a second antigen binding domain that specifically binds a second antigen of the disclosure for use in the manufacture of a medicament for use in therapy.

The disclosure also provides the bispecific or multispecific protein comprising a first antigen binding domain that specifically binds HLA-G and a second antigen binding domain that specifically binds a second antigen of the disclosure for use in the manufacture of a medicament for use in treating a cell proliferative disorder.

The disclosure also provides the bispecific or multispecific protein comprising a first antigen binding domain that specifically binds HLA-G and a second antigen binding domain that specifically binds a second antigen of the disclosure for use in the manufacture of a medicament for treating cancer.

The disclosure also provides a method of treating cancer in a subject, comprising administering a therapeutically effective amount of the multispecific protein comprising the antigen binding domain that binds HLA-G to the subject to treat the cancer, wherein the antigen binding domain that bind HLA-G comprises the VH of SEQ ID NO: 50 and the VL of SEQ ID NO: 51;
the VH of SEQ ID NO: 52 and the VL of SEQ ID NO: 53;
the VH of SEQ ID NO: 54 and the VL of SEQ ID NO: 55;
the VH of SEQ ID NO: 56 and the VL of SEQ ID NO: 57;
the VH of SEQ ID NO: 58 and the VL of SEQ ID NO: 59;
the VH of SEQ ID NO: 60 and the VL of SEQ ID NO: 61;
the VH of SEQ ID NO: 62 and the VL of SEQ ID NO: 63;
the VH of SEQ ID NO: 64 and the VL of SEQ ID NO: 65;
the VH of SEQ ID NO: 66 and the VL of SEQ ID NO: 67; or
the VH of SEQ ID NO: 68 and the VL of SEQ ID NO: 69.

The disclosure also provides a method of treating cancer in a subject, comprising administering a therapeutically effective amount of the multispecific protein comprising the antigen binding domain that binds HLA-G to the subject to treat the cancer, wherein the antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

A further aspect of the disclosure is a method of treating a cell proliferative disorder in a subject in need thereof, the method comprising administering to the subject a therapeutically effective amount of the bispecific or multispecific protein comprising a first antigen binding domain that specifically binds HLA-G and a second antigen binding domain that specifically binds a second antigen of the disclosure. In other embodiments, the bispecific or multispecific protein comprising a first antigen binding domain that specifically binds HLA-G and a second antigen binding domain that specifically binds a second antigen of the disclosure, is administered to the subject.

In any of the preceding uses or methods, the cell proliferative disorder is cancer. In other embodiments, the cancer is selected from the group consisting of a lung cancer, a pancreatic cancer, a renal cancer, a head and neck cancer, an ovarian cancer, an esophageal cancer, a breast cancer, a uterine cancer, a melanoma, a neuroblastoma, a glioblastoma, a colorectal cancer, a gastric cancer, a parathyroid cancer, a bladder cancer, a liver cancer, a hepatocellular carcinoma, a pleural mesothelioma, a prostate cancer, a cholangiocarcinoma, a thyroid cancer, an embryonal carcinoma, a seminoma, a uveal melanoma, a pheochromocytoma, a teratoma, a thymoma, an adrenocortical carcinoma, an astrocytoma, a synovial sarcoma, a myelodysplastic syndrome, an acute myeloid leukemia (AML), a Hodgkin lymphoma, a multiple myeloma (MM), a non-Hodgkin's lymphoma, and a B-cell chronic lymphoid leukemia.

In other embodiments, the cancer is lung cancer. In other embodiments, the lung cancer is non-small cell lung cancer (NSCLC), small cell lung cancer (SCLC) or lung adenocarcinoma. In other embodiments, the cancer is pancreatic cancer. In other embodiments, the cancer is an adenocarcinoma, for example, a metastatic adenocarcinoma (e.g., a lung adenocarcinoma, a gastric adenocarcinoma, or a pancreatic adenocarcinoma).

In other embodiments, the renal cancer is Clear Cell Renal Cell Carcinoma (CCRCC).

In other embodiments, the renal cancer is papillary type.

In other embodiments, the ovarian cancer is high grade serous cancer of the ovary, peritoneum, or fallopian tube.

In other embodiments, the ovarian cancer has an elevated blood marker (e.g., CA 125) or cancer related fluid that can be monitored.

In other embodiments, the breast cancer is triple-negative breast cancer (TNBC).

In another aspect, the disclosure features a kit comprising: (a) a composition comprising any one of the preceding the bispecific or multispecific protein comprising a first antigen binding domain that specifically binds HLA-G and a second antigen binding domain that specifically binds a second antigen of the disclosure and (b) a package insert comprising instructions for administering the composition to a subject to treat or delay progression of a cell proliferative disorder.

In any of the preceding uses or methods, the subject can be a human.

EMBODIMENTS

The invention provides the following non-limiting embodiments.

1) An isolated protein comprising an antigen binding domain that binds human leukocyte antigen G (HLA-G), wherein the antigen binding domain that binds HLA-G comprises
   a) a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or
   b) the HCDR1, the HCDR2 and the HCDR3 of the VH of SEQ ID NO: 52 and the LCDR1, the LCDR2 and the LCDR3 of the VL of SEQ ID NO: 53; or
   c) the HCDR1, the HCDR2 and the HCDR3 of the VH of SEQ ID NO: 54 and the LCDR1, the LCDR2 and the LCDR3 of the VL of SEQ ID NO: 55; or
   d) the HCDR1, the HCDR2 and the HCDR3 of the VH of SEQ ID NO: 56 and the LCDR1, the LCDR2 and the LCDR3 of the VL of SEQ ID NO: 57; or
   e) the HCDR1, the HCDR2 and the HCDR3 of the VH of SEQ ID NO: 58 and the LCDR1, the LCDR2 and the LCDR3 of the VL of SEQ ID NO: 59; or
   f) the HCDR1, the HCDR2 and the HCDR3 of the VH of SEQ ID NO: 60 and the LCDR1, the LCDR2 and the LCDR3 of the VL of SEQ ID NO: 61; or
   g) the HCDR1, the HCDR2 and the HCDR3 of the VH of SEQ ID NO: 62 and the LCDR1, the LCDR2 and the LCDR3 of the VL of SEQ ID NO: 63; or
   h) the HCDR1, the HCDR2 and the HCDR3 of the VH of SEQ ID NO: 64 and the LCDR1, the LCDR2 and the LCDR3 of the VL of SEQ ID NO: 65; or
   i) the HCDR1, the HCDR2 and the HCDR3 of the VH of SEQ ID NO: 66 and the LCDR1, the LCDR2 and the LCDR3 of the VL of SEQ ID NO: 67; or
   j) the HCDR1, the HCDR2 and the HCDR3 of the VH of SEQ ID NO: 68 and the LCDR1, the LCDR2 and the LCDR3 of the VL of SEQ ID NO: 69.

2) The isolated protein of Embodiment 1, comprising the HCDR1, the HCDR2, the HCDR3, the LCDR1, the LCDR2 and the LCDR3 of
   a) SEQ ID NOs: 70, 71, 72, 88, 89, and 90, respectively;
   b) SEQ ID NOs: 73, 71, 74, 91, 89, and 92, respectively;
   c) SEQ ID NOs: 75, 76, 77, 93, 89, and 94, respectively;

d) SEQ ID NOs: 78, 79, 80, 95, 89, and 96, respectively;
e) SEQ ID NOs: 81, 82, 83, 97, 89, and 98, respectively;
f) SEQ ID NOs: 78, 71, 84, 99, 89, and 100, respectively;
g) SEQ ID NOs: 78, 71, 84, 101, 89, and 100, respectively;
h) SEQ ID NOs: 85, 86, 87, 102, 103, and 104, respectively; or
i) SEQ ID NOs: 78, 71, 84, 95, 89, and 96, respectively.

3) The isolated protein of Embodiment 1 or 2, wherein the antigen binding domain that binds HLA-G is a scFv, a (scFv)$_2$, a Fv, a Fab, a F(ab')$_2$, a Fd, a dAb or a VHH.

4) The isolated protein of Embodiment 3, wherein the antigen binding domain that binds HLA-G is the Fab.

5) The isolated protein of Embodiment 3, wherein the antigen binding domain that binds HLA-G is the scFv.

6) The isolated protein of Embodiment 5, wherein the scFv comprises, from the N- to C-terminus, a VH, a first linker (L1) and a VL (VH-L1-VL) or the VL, the L1 and the VH (VL-L1-VH).

7) The isolated protein of Embodiment 6, wherein the L1 comprises
a) about 5-50 amino acids;
b) about 5-40 amino acids;
c) about 10-30 amino acids; or
d) about 10-20 amino acids.

8) The isolated protein of Embodiment 6, wherein the L1 comprises an amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

9) The isolated protein of Embodiment 8 wherein the L1 comprises the amino acid sequence of SEQ ID NO: 8.

10) The isolated protein of any one of Embodiments 1-9, wherein the antigen binding domain that binds HLA-G comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

11) The isolated protein of Embodiment 10, wherein the antigen binding domain that binds HLA-G comprises:
a) the VH of SEQ ID NO: 50 and the VL of SEQ ID NO: 51;
b) the VH of SEQ ID NO: 52 and the VL of SEQ ID NO: 53;
c) the VH of SEQ ID NO: 54 and the VL of SEQ ID NO: 55;
d) the VH of SEQ ID NO: 56 and the VL of SEQ ID NO: 57;
e) the VH of SEQ ID NO: 58 and the VL of SEQ ID NO: 59;
f) the VH of SEQ ID NO: 60 and the VL of SEQ ID NO: 61;
g) the VH of SEQ ID NO: 62 and the VL of SEQ ID NO: 63;
h) the VH of SEQ ID NO: 64 and the VL of SEQ ID NO: 65;
i) the VH of SEQ ID NO: 66 and the VL of SEQ ID NO: 67; or
j) the VH of SEQ ID NO: 68 and the VL of SEQ ID NO: 69;

12) The isolated protein of any one of Embodiments 1-11, wherein the antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

13) The isolated protein of any one of Embodiments 1-12, wherein the protein is conjugated to a half-life extending moiety.

14) The isolated protein of Embodiment 13, wherein the half-life extending moiety is an immunoglobulin (Ig), a fragment of the Ig, an Ig constant region, a fragment of the Ig constant region, a Fc region, transferrin, albumin, an albumin binding domain or polyethylene glycol.

15) The isolated protein of any one of Embodiments 1-14, wherein the isolated protein is a monospecific protein.

16) The isolated protein of any one of Embodiments 1-14, wherein the isolated protein is a multispecific protein.

17) The isolated protein of Embodiment 16, wherein the multispecific protein is a bispecific protein.

18) The isolated protein of Embodiment 16, wherein the multispecific protein is a trispecific protein.

19) The isolated protein of any one of Embodiments 1-18, further comprising an immunoglobulin (Ig) constant region or a fragment of the Ig constant region thereof.

20) The isolated protein of Embodiment 19, wherein the fragment of the Ig constant region comprises a Fc region.

21) The isolated protein of Embodiment 19, wherein the fragment of the Ig constant region comprises a CH2 domain.

22) The isolated protein of Embodiment 19, wherein the fragment of the Ig constant region comprises a CH3 domain.

23) The isolated protein of Embodiment 19, wherein the fragment of the Ig constant region comprises the CH2 domain and the CH3 domain.

24) The isolated protein of Embodiment 19, wherein the fragment of the Ig constant region comprises at least portion of a hinge, the CH2 domain and the CH3 domain.

25) The isolated protein of Embodiment 19, wherein the fragment of the Ig constant region comprises a hinge, the CH2 domain and the CH3 domain.

26) The isolated protein of any one of Embodiments 19-25, wherein the antigen binding domain that binds HLA-G is conjugated to the N-terminus of the Ig constant region or the fragment of the Ig constant region.

27) The isolated protein of any one of Embodiments 19-25, wherein the antigen binding domain that binds HLA-G is conjugated to the C-terminus of the Ig constant region or the fragment of the Ig constant region.

28) The isolated protein of any one of Embodiments 19-27, wherein the antigen binding domain that binds HLA-G is conjugated to the Ig constant region or the fragment of the Ig constant region via a second linker (L2).

29) The isolated protein of Embodiment 41, wherein the L2 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

30) The isolated protein of any one of Embodiments 16-29, wherein the multispecific protein comprises an antigen binding domain that binds an antigen on a lymphocyte.

31) The isolated protein of Embodiment 30, wherein the lymphocyte is a T cell.

32) The isolated protein of Embodiment 30, wherein the T cell is a CD8⁺ T cell

33) The isolated protein of Embodiment 30, wherein the lymphocyte is a natural killer (NK) cell.

34) The isolated protein of any one of Embodiments 16-33, wherein the multispecific protein comprises an antigen binding domain that binds CD3, CD3 epsilon (CD3E), CD8, KI2L4, NKG2E, NKG2D, NKG2F, BTNL3, CD186, BTNL8, PD-1, CD195, or NKG2C.

35) The isolated protein of Embodiment 34, wherein the multispecific protein comprises an antigen binding domain that binds CD3E.

36) The isolated protein of Embodiment 48, wherein the antigen binding domain that binds CD3E comprises:
   a) a heavy chain complementarity determining region 1 (HCDR1) of SEQ ID NO: 361, a HCDR2 of SEQ ID NO: 362, a HCDR3 of SEQ ID NO: 363, a light chain complementarity determining region 1 (LCDR1) of SEQ ID NO: 367, a LCDR2 of SEQ ID NO: 368 and a LCDR3 of SEQ ID NO: 369;
   b) the VH of SEQ ID NO: 339 and the VL of SEQ ID NO: 340;
   c) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 370;
   d) the VH of SEQ ID NO: 339 and the VL of SEQ ID NO: 341;
   e) the VH of SEQ ID NO: 339 and the VL of SEQ ID NO: 342;
   f) the VH of SEQ ID NO: 339 and the VL of SEQ ID NO: 343;
   g) the VH of SEQ ID NO: 339 and the VL of SEQ ID NO: 344;
   h) the VH of SEQ ID NO: 339 and the VL of SEQ ID NO: 345;
   i) the HCDR1 of SEQ ID NO: 364, the HCDR2 of SEQ ID NO: 365, the HCDR3 of SEQ ID NO: 366, the LCDR1 of SEQ ID NO: 371, the LCDR2 of SEQ ID NO: 372 and the LCDR3 of SEQ ID NO: 373;
   j) the VH of SEQ ID NO: 346 and the VL of SEQ ID NO: 347; or
   k) the VH of SEQ ID NO: 348 and the VL of SEQ ID NO: 349.

37) The isolated protein of any one of Embodiments 19-36, wherein the Ig constant region or the fragment of the Ig constant region is an IgG1, an IgG2, an IgG3 or an IgG4 isotype.

38) The isolated protein of any one of Embodiments 19-37, wherein the Ig constant region or the fragment of the Ig constant region comprises at least one mutation that results in reduced binding of the protein to a Fcγ receptor (FcγR).

39) The isolated protein of Embodiment 38, wherein the at least one mutation that results in reduced binding of the protein to the FcγR is selected from the group consisting of L235A/D265S, F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

40) The isolated protein of any one of Embodiments 19-37, wherein the Ig constant region or the fragment of the Ig constant region comprises at least one mutation that results in enhanced binding of the protein to the FcγR.

41) The isolated protein of Embodiment 40, wherein the at least one mutation that results in enhanced binding of the protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

42) The isolated protein of any one of Embodiments 38-41, wherein the FcγR is FcγR1, FcγRIIA, FcγRIIB or FcγRIII, or any combination thereof 43) The isolated protein of any one of Embodiments 19-42, wherein the Ig constant region of the fragment of the Ig constant region comprises at least one mutation that modulates a half-life of the protein.

44) The isolated protein of Embodiment 43, wherein the at least one mutation that modulates the half-life of the protein is selected from the group consisting of H435A, P257I/N434H, D376V/N434H, M252Y/S254T/T256E/H433K/N434F, T308P/N434A and H435R, wherein residue numbering is according to the EU index.

45) The isolated protein of any one of the Embodiments 19-44, wherein the protein comprises at least one mutation in a CH3 domain of the Ig constant region.

46) The isolated protein of Embodiment 45, wherein the at least one mutation in the CH3 domain of the Ig constant region is selected from the group consisting of T350V, L351Y, F405A, Y407V, T366Y, T366W, F405W, T394W, T394S, Y407T, Y407A, T366S/L368A/Y407V, L351Y/F405A/Y407V, T366I/K392M/T394W, F405A/Y407V, T366L/K392M/T394W, L351Y/Y407A, T366A/K409F, L351Y/Y407A, T366V/K409F, T366A/K409F, T350V/L351Y/F405A/Y407V and T350V/T366L/K392L/T394W, wherein residue numbering is according to the EU index.

47) An isolated multispecific protein comprising a first antigen binding domain that binds HLA-G and a second antigen binding domain that binds a lymphocyte antigen.

48) The isolated multispecific protein of Embodiment 47, wherein the lymphocyte antigen is a T cell antigen.

49) The isolated multispecific protein of Embodiment 47, wherein the T cell antigen is a CD8⁺ T cell antigen.

50) The isolated multispecific protein of Embodiment 47, wherein the lymphocyte antigen is a NK cell antigen.

51) The isolated multispecific protein of any one of Embodiments 47-50, wherein the lymphocyte antigen is CD3, CD3 epsilon (CD3E), CD8, KI2L4, NKG2E, NKG2D, NKG2F, BTNL3, CD186, BTNL8, PD-1, CD195, or NKG2C.

52) The isolated multispecific protein of Embodiment 51, wherein the lymphocyte antigen is CD3E.

53) The isolated multispecific protein of any one of Embodiments 47-52, wherein the first antigen binding domain that binds HLA-G and/or the second antigen binding domain that binds the lymphocyte antigen comprise a scFv, a (scFv)₂, a Fv, a Fab, a F(ab')₂, a Fd, a dAb or a Win 54) The isolated multispecific protein of Embodiment 53, wherein the first antigen binding domain that binds HLA-G and/or the second antigen binding domain that binds the lymphocyte antigen comprise the Fab.

55) The isolated multispecific protein of Embodiment 53, wherein the first antigen binding domain that binds HLA-G and/or the second antigen binding domain that binds the lymphocyte antigen comprise the scFv.

56) The isolated multispecific protein of Embodiment 55, wherein the scFv comprises, from the N- to C-terminus, a VH, a first linker (L1) and a VL (VH-L1-VL) or the VL, the L1 and the VH (VL-L1-VH).

57) The isolated multispecific protein of Embodiment 56, wherein the L1 comprises
   a) about 5-50 amino acids;
   b) about 5-40 amino acids;
   c) about 10-30 amino acids; or
   d) about 10-20 amino acids.

58) The isolated multispecific protein of Embodiment 57, wherein the L1 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

59) The isolated multispecific protein of Embodiment 58, wherein the L1 comprises the amino acid sequence of SEQ ID NO: 8.

60) The isolated multispecific protein of any one of Embodiments 47-59, wherein the first antigen binding domain that binds HLA-G comprises the HCDR1 of SEQ ID NOs: 70, 73, 75, 78, 81, or 85, the HCDR2 of SEQ ID NOs: 71, 76, 79, 82, or 86, the HCDR3 of SEQ ID NOs: 72, 74, 77, 80, 83, 84, or 87, the LCDR1 of SEQ ID NOs: 88, 91, 93, 95, 97, 99, 101, or 102, the LCDR2 of SEQ ID NOs: 89 or 103, and the LCDR3 of SEQ ID NOs: 90, 92, 94, 96, 98, 100, or 104.

61) The isolated multispecific protein of any one of Embodiments 47-60, wherein the first antigen binding domain that binds HLA-G comprises the HCDR1, the HCDR2, the HCDR3, the LCDR1, the LCDR2 and the LCDR3 of
   a) SEQ ID NOs: 70, 71, 72, 88, 89, and 90, respectively;
   b) SEQ ID NOs: 73, 71, 74, 91, 89, and 92, respectively;
   c) SEQ ID NOs: 75, 76, 77, 93, 89, and 94, respectively;
   d) SEQ ID NOs: 78, 79, 80, 95, 89, and 96, respectively;
   e) SEQ ID NOs: 81, 82, 83, 97, 89, and 98, respectively;
   f) SEQ ID NOs: 78, 71, 84, 99, 89, and 100, respectively;
   g) SEQ ID NOs: 78, 71, 84, 101, 89, and 100, respectively;
   h) SEQ ID NOs: 85, 86, 87, 102, 103, and 104, respectively; or
   i) SEQ ID NOs: 78, 71, 84, 95, 89, and 96, respectively.

62) The isolated multispecific protein of any one of Embodiments 47-61, wherein the first antigen binding domain that binds HLA-G comprises
   a) the VH of SEQ ID NO: 50 and the VL of SEQ ID NO: 51;
   b) the VH of SEQ ID NO: 52 and the VL of SEQ ID NO: 53;
   c) the VH of SEQ ID NO: 54 and the VL of SEQ ID NO: 55;
   d) the VH of SEQ ID NO: 56 and the VL of SEQ ID NO: 57;
   e) the VH of SEQ ID NO: 58 and the VL of SEQ ID NO: 59;
   f) the VH of SEQ ID NO: 60 and the VL of SEQ ID NO: 61;
   g) the VH of SEQ ID NO: 62 and the VL of SEQ ID NO: 63;
   h) the VH of SEQ ID NO: 64 and the VL of SEQ ID NO: 65;
   i) the VH of SEQ ID NO: 66 and the VL of SEQ ID NO: 67; or
   j) the VH of SEQ ID NO: 68 and the VL of SEQ ID NO: 69.

63) The isolated multispecific protein of any one of Embodiments 47-61, wherein the first antigen binding domain that binds HLA-G comprises the VH of SEQ ID NOs: 50, 52, 54, 56, 58, 60, 62, 64, 66, or 68, and the VL of SEQ ID NOs: 51, 53, 55, 57, 59, 61, 63, 65, 67, or 69.

64) The isolated multispecific protein of any one of Embodiments 47-63, wherein the first antigen binding domain that binds HLA-G comprises the amino acid sequence of SEQ ID NOs: 248, 249, 250, 251, 252, 253, 254, 255, 256, 257, 258, 259, 260, 261, 262, 263, 264, 265, 266, 267, 268, or 269.

65) The isolated multispecific protein of any one of Embodiments 47-56, wherein the second antigen binding domain that binds the lymphocyte antigen comprises
   a) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 369;
   b) the VH of SEQ ID NO: 339 and the VL of SEQ ID NO: 340;
   c) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 370;
   d) the VH of SEQ ID NO: 339 and the VL of SEQ ID NO: 341;
   e) the VH of SEQ ID NO: 339 and the VL of SEQ ID NO: 342;
   f) the VH of SEQ ID NO: 339 and the VL of SEQ ID NO: 343;
   g) the VH of SEQ ID NO: 339 and the VL of SEQ ID NO: 344;
   h) the VH of SEQ ID NO: 339 and the VL of SEQ ID NO: 345;
   i) the HCDR1 of SEQ ID NO: 364, the HCDR2 of SEQ ID NO: 365, the HCDR3 of SEQ ID NO: 366, the LCDR1 of SEQ ID NO: 371, the LCDR2 of SEQ ID NO: 372 and the LCDR3 of SEQ ID NO: 373;
   j) the VH of SEQ ID NO: 346 and the VL of SEQ ID NO: 347; or
   k) the VH of SEQ ID NO: 348 and the VL of SEQ ID NO: 349.

66) The isolated multispecific protein of any one of Embodiments 47-65, wherein the first antigen binding domain that binds HLA-G is conjugated to a first immunoglobulin (Ig) constant region or a fragment of the first Ig constant region and/or the second antigen binding domain that binds the lymphocyte antigen is conjugated to a second immunoglobulin (Ig) constant region or a fragment of the second Ig constant region.

67) The isolated multispecific protein of Embodiment 66, further comprising a second linker (L2) between the first antigen binding domain that binds HLA-G and the first Ig constant region or the fragment of the first Ig constant region and the second antigen binding domain that binds the lymphocyte antigen and the second Ig constant region or the fragment of the second Ig constant region.
68) The isolated multispecific protein of Embodiment 67, wherein the L2 comprises the amino acid sequence of SEQ ID NOs: 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.
69) The isolated multispecific protein of any one of Embodiments 66-68, wherein the first Ig constant region or the fragment of the first Ig constant region and the second Ig constant region or the fragment of the second Ig constant region is an IgG1, an IgG2, and IgG3 or an IgG4 isotype.
70) The isolated multispecific protein of Embodiment 66-69, wherein the first Ig constant region or the fragment of the first Ig constant region and the second Ig constant region or the fragment of the second Ig constant region comprises at least one mutation that results in reduced binding of the multispecific protein to a FcγR.
71) The isolated multispecific protein of Embodiment 70, wherein the at least one mutation that results in reduced binding of the multispecific protein to the FcγR is selected from the group consisting of L235A/D265S, F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.
72) The isolated multispecific protein of any one of Embodiments 66-69, wherein the first Ig constant region or the fragment of the first Ig constant region and the second Ig constant region or the fragment of the second Ig constant region comprises at least one mutation that results in enhanced binding of the multispecific protein to a Fcγ receptor (FcγR).
73) The isolated multispecific protein of Embodiment 72, wherein the at least one mutation that results in enhanced binding of the multispecific protein to the FcγR is selected from the group consisting of 5239D/I332E, S298A/E333A/K334A, F243L/R292P/Y300L, F243L/R292P/Y300L/P396L, F243L/R292P/Y300L/V305I/P396L and G236A/5239D/1332E, wherein residue numbering is according to the EU index.
74) The isolated multispecific protein of any one of Embodiments 70-73, wherein the FcγR is FcγR1, FcγRIIA, FcγRIIB or FcγRIII, or any combination thereof.
75) The isolated multispecific protein of any one of Embodiments 66-74, wherein the first Ig constant region or the fragment of the first Ig constant region and the second Ig constant region or the fragment of the second Ig constant region comprises at least one mutation that modulates a half-life of the multispecific protein.
76) The isolated multispecific protein of Embodiment 75, wherein the at least one mutation that modulates the half-life of the multispecific protein is selected from the group consisting of H435A, P257I/N434H, D376V/N434H, M252Y/S254T/T256E/H433K/N434F, T308P/N434A and H435R, wherein residue numbering is according to the EU index.
77) The isolated multispecific protein of any one of the Embodiments 66-76, comprising at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region.
78) The isolated multispecific protein of Embodiment 77, wherein the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region is selected from the group consisting of T350V, L351Y, F405A, Y407V, T366Y, T366W, F405W, T394W, T394S, Y407T, Y407A, T366S/L368A/Y407V, L351Y/F405A/Y407V, T366I/K392M/T394W, F405A/Y407V, T366L/K392M/T394W, L351Y/Y407A, T366A/K409F, L351Y/Y407A, T366V/K409F, T366A/K409F, T350V/L351Y/F405A/Y407V and T350V/T366L/K392L/T394W, wherein residue numbering is according to the EU index.
79) The isolated multispecific protein of any one of Embodiments 66-78, wherein the first Ig constant region or the fragment of the first Ig constant region and the second Ig constant region or the fragment of the second Ig constant region comprise the following mutations:
  a) L235A_D265S_T350V_L351Y_F405A_Y407V in the first Ig constant region and L235A_D265S_T350V_T366L_K392L_T394W in the second Ig constant region; or
  b) L235A_D265S_T350V_T366L_K392L_T394W in the first Ig constant region and L235A_D265S_T350V_L351Y_F405A_Y407V in the second Ig constant region.
80) An immunoconjugate comprising the isolated protein of any one of Embodiments 1-46 conjugated to a therapeutic agent or an imaging agent.
81) A pharmaceutical composition comprising the isolated protein of any one of Embodiments 1-46 and a pharmaceutically acceptable carrier.
82) A polynucleotide encoding the isolated protein of any one of Embodiments 1-46.
83) A vector comprising the polynucleotide of Embodiment 82.
84) A host cell comprising the vector of Embodiment 83.
85) A method of producing the isolated protein of any one of Embodiments 1-46, comprising culturing the host cell of Embodiment 84 in conditions that the protein is expressed, and recovering the protein produced by the host cell.
86) An immunoconjugate comprising the isolated multispecific protein of any one of Embodiments 47-79 conjugated to a therapeutic agent or an imaging agent.
87) A pharmaceutical composition comprising the isolated multispecific protein of any one of Embodiments 47-79 and a pharmaceutically acceptable carrier.
88) A polynucleotide encoding the isolated multispecific protein of any one of Embodiments 47-79.
89) A vector comprising the polynucleotide of Embodiment 88.

90) A host cell comprising the vector of Embodiment 89.
91) A method of producing the isolated multispecific protein of any one of Embodiments 47-79, comprising culturing the host cell of Embodiment 90 in conditions that the multispecific protein is expressed, and recovering the multispecific protein produced by the host cell.
92) A method of treating a HLA-G expressing cancer in a subject, comprising administering a therapeutically effective amount of the isolated protein of any one of Embodiments 1-46, the isolated multispecific protein of any one of Embodiments 47-79, the immunoconjugate of Embodiment 80 or 86, or the pharmaceutical composition of Embodiment 81 or 87 to the subject for a time sufficient to treat the HLA-G expressing cancer.
93) A method of reducing the amount of HLA-G expressing tumor cells in a subject, comprising administering the isolated protein of any one of Embodiments 1-46, the isolated multispecific protein of any one of Embodiments 47-79, the immunoconjugate of Embodiment 80 or 86, or the pharmaceutical composition of Embodiment 81 or 87 to the subject for a time sufficient to reduce the amount of HLA-G expressing tumor cells.
94) The method of any one of Embodiments 92-93, wherein the HLA-G expressing cancer is a lung cancer, a pancreatic cancer, a renal cancer, a head and neck cancer, an ovarian cancer, an esophageal cancer, or a breast cancer.
95) The method of any one of Embodiments 92-94, wherein the isolated protein or the isolated multispecific protein is administered in combination with a second therapeutic agent.
96) The method of Embodiment 95, wherein the second therapeutic agent is surgery, chemotherapy, or radiation, or any combination thereof
97) A method of detecting the presence of cancer in a subject, comprising administering the immunoconjugate of Embodiment 80 or 86 to a subject suspected to have cancer and visualizing the biological structures to which the immunoconjugate is bound, thereby detecting the presence of cancer.
98) A kit comprising the isolated protein of any one of Embodiments 1-46, the isolated multispecific protein of any one of Embodiments 47-79, the immunoconjugate of Embodiment 80 or 86, or the pharmaceutical composition of Embodiment 81 or 87.
99) An anti-idiotypic antibody binding to the isolated protein of any one of Embodiments 1-46.
100) An isolated protein comprising an antigen binding domain that binds to an epitope on HLA-G, wherein the epitope is a discontinuous epitope comprising the amino acid sequences of HHPVFDYE (SEQ ID NO: 485) and VPS.
101) An isolated protein comprising an amino acid sequence of SEQ ID NOs: 478 or 479.
102) An isolated protein comprising an amino acid sequence of SEQ ID NOs: 478.
103) An isolated protein comprising an amino acid sequence of SEQ ID NOs: 479.
104) The isolated protein of Embodiment 102 comprising an amino acid sequence of SEQ ID NO: 490.
105) The isolated protein of Embodiments 102 or 104 further comprising amino acid sequences of SEQ ID NOs: 489 and 447.
106) The isolated protein of Embodiment 105 further comprising an amino acid sequence of SEQ ID NO: 439.
107) An isolated protein comprising amino acid sequences of SEQ ID NOs: 465 and 468.
108) An isolated protein comprising amino acid sequences of SEQ ID NOs: 466 and 469.
109) An isolated protein comprising amino acid sequences of SEQ ID NOs: 467 and 470.

The following examples are provided to further describe some of the embodiments disclosed herein. The examples are intended to illustrate, not to limit, the disclosed embodiments.

EXAMPLES

Example 1. Generation of HLA-G Cell Line

K562 chronic myelogenous leukemia cell line (ATCC, CCL-243) lacking expression of all HLAs, including the MHC class I proteins: HLA-A (Uniprot P01892), HLA-B (Uniprot P18464), HLA-C (Uniprot P30508), and HLA-E (Uniprot P13747) (therefore suitable for NK cell based killing), was transduced using a pCDH lentiviral vector to express HLA-G1-IRES (internal ribosome entry site)-β-2-microglobulin (β2M, LPP-CS-Z7412-I0035-02-200, Genecopoeia) or the human HLA-G (C42S)-IRES-β2M (LPP-CS-Z7412-I0035-01-200, Genecopoeia) in lentiviral particles (Genecopoeia) and cultured in IMDM, 10% FBS. At passage one, selection with 10 μg/ml puromycin (Gibco, A1113803) to ensure stable HLA-G expression. Cells were split 1:10 when density reached ~$3\times10^6$ cells/ml, approximately every 3-4 days.

Example 2: Generation of HLA-G Antibodies

Anti-HLA-G antibodies were generated using OmniRat® transgenic humanized rats. The OmniRat® contains a chimeric human/rat IgH locus (comprising 22 human VHS, all human D and JH segments in natural configuration linked to the rat CH locus) together with fully human IgL loci (12 Vκs linked to Jκ-Cκ and 16 Vλs linked to Jλ-Cλ). (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in WO14/093908.

OmniRat® rats were immunized using a construct comprising a subunit of either recombinant human HLA-G1 or recombinant human HLA-G5, a soluble isoform of HLA-G containing the α1, α2, and α3 domains but lacking the transmembrane region, fused to the β2m subunit and histone H2A, K562 cells expressing HLA-G1, or DNA encoding HLA-G1 extracellular domain with C42S mutation (Table 1). In some cases the histone H2A peptide was fused to the antigen for enhanced stability. Table 4 shows the sequences of the antigens. The immunizations of OmniRat® rats were carried out in Belgium.

TABLE 4

Sequences of antigens used to generate antibodies.
H2A peptide is underlined. The β2M subunit is highlighted bold. His, Avi-, and Gly-Ser tags are italicized.

| Campaign | Protein AA ID | Sequence | SEQ ID NO: |
|---|---|---|---|
| HYB:420, Hybridoma, OMT rats | MHGW8 (B2m-(3(G4S)-HLA-G1-G4S-Avi) | MIQRTPKIQVYSRHPAENGKSNFLNCYVSGFHPSDIEV DLLKNGERIEKVEHSDLSFSKDWSFYLLYYTEFTPTEK DEYACRVNHVTLSQPKIVKWDRDMGGGGSGGGGSGG GGSGSHSMRYFSAAVSRPGRGEPRFIAMGYVDDTQFV RFDSDSASPRMEPRAPWVEQEGPEYWEEETRNTKAHA QTDRMNLQTLRGYYNQSEASSHTLQWMIGCDLGSDGR LLRGYEQYAYDGKDYLALNEDLRSVVTAADTAAQISKRK CEAANVAEQRRAYLEGTCVEWLHRYLENGKEMLQRAD PPKTHVTHHPVFDYEATLRCWALGFYPAEIILTWQRDGE DQTQDVELVETRPAGDGTFQKWAAVVVPSGEEQRYTC HVQHEGLPEPLMLRWKQSSLPTIPI*GGGGSGLNDIFEAQ KIEWHE* | 41 |
| HYB:420, Hybridoma, OMT rats | MHGVV2 (H2A-2(G4S)-b2m-3(G4S)-HLA-G5-G4S-His-Avi) | <u>RIIPRHLQL</u>GGGGSGGGGSIQRTPKIQVYSRHPAENGK SNFLNCYVSGFHPSDIEVDLLKNGERIEKVEHSDLSFSK DWSFYLLYYTEFTPTEKDEYACRVNHVTLSQPKIVKWD RDMGGGGSGGGGSGGGGSGSHSMRYFSAAVSRPGR GEPRFIAMGYVDDTQFVRFDSDSASPRMEPRAPWVEQ EGPEYWEEETRNTKAHAQTDRMNLQTLRGYYNQSEAS SHTLQWMIGCDLGSDGRLLRGYEQYAYDGKDYLALNE DLRSWTAADTAAQISKRKCEAANVAEQRRAYLEGTCVE WLHRYLENGKEMLQRADPPKTHVTHHPVFDYEATLRC WALGFYPAEIILTWQRDGEDQTQDVELVETRPAGDGTF QKWAAVVVPSGEEQRYTCHVQHEGLPEPLMLRWSKE GDGGIMSVRESRSLSEDL*GGGGSHHHHHHGSGLNDIF EAQKIEWHE* | 42 |
| HYB:420, Hybridoma, OMT rats | _FL_HLA-G1 | GSHSMRYFSAAVSRPGRGEPRFIAMGYVDDTQFVRFD SDSACPRMEPRAPWVEQEGPEYWEEETRNTKAHAQT DRMNLQTLRGYYNQSEASSHTLQWMIGCDLGSDGRLL RGYEQYAYDGKDYLALNEDLRSWTAADTAAQISKRKCE AANVAEQRRAYLEGTCVEWLHRYLENGKEMLQRADPP KTHVTHHPVFDYEATLRCWALGFYPAEIILTWQRDGED QTQDVELVETRPAGDGTFQKWAAVVVPSGEEQRYTCH VQHEGLPEPLMLRWKQSSLPTIPIMGIVAGLVVLAAVVT GAAVAAVLWRKKSSD | 43 |
| HYB:423, Hybridoma, OMT rats | pDR000057441 (H2A-3(G4S)-b2m-3G4S-HLA-G1-C42S) | DNA sequence, primary transcript: ATGGGCTTGGGTGTGGACATTGTTGTTTCTGATGGCTG CTGCTCAATCTATTCAAGCTAGGATCATTCCTAGACAT CTGCAACTCGGAGGCGGAGGCAGCGGAGGAGGAGG ATCTGGAGGAGGAGGATCTATTCAGAGGACACCTAA GATTCAAGTGTACTCTAGACATCCTGCTGAGAACGGC AAGAGCAACTTTCTGAACTGCTATGTGAGCGGCTTTC ATCCTAGCGATATTGAAGTGGATCTGCTGAAAAACGG CGAACGTATTGAAAAAGTGGAACATAGCGATCTGAGC TTTAGCAAAGATTGGAGCTTTTATCTGCTGTATTATAC CGAATTTACCCCTACCGAAAAAGATGAATATGCCTGC AGAGTGAACCATGTGACCCTGAGCCAGCCTAAGATTG TGAAATGGGATAGAGATATGGGAGGAGGAGGCTCTG GAGGAGGAGGATCTGGAGGCGGAGGCAGCGGCTCT CATAGCATGAGATATTTTAGCGCTGCAGTGAGCCGTC CTGGACGTGGAGAACCTAGGTTTATTGCTATGGGCTA TGTGGATGATACCCAGTTTGTGAGGTTTGATAGCGAT AGCGCCTCTCCTAGGATGGAACCTAGAGCTCCCTGG GTGGAACAGGAAGGCCCAGAATATTGGGAAGAAGAA ACCAGGAACACCAAAGCACATGCTCAGACCGATCGTA TGAACCTGCAGACCCTGAGAGGCTATTATAACCAGAG CGAAGCATCTAGCCATACCCTGCAGTGGATGATTGGC TGCGATCTGGGCAGCGATGGCAGACTGCTGAGAGGC TATGAACAGTATGCATATGATGGCAAAGATTATCTGG CACTGAACGAAGATCTGAGGAGCTGGACCGCTGCTG ATACCGCTGCTCAGATTAGCAAGAGGAAGTGCGAAG CTGCTAACGTGGCTGAACAGAGACGCGCATATCTGG AAGGCACCTGCGTGGAATGGCTGCATAGGTATCTGG AAAACGGCAAAGAAATGCTGCAGAGAGCTGATCCTCC TAAAACCCATGTGACCCATCATCCTGTGTTTGATTATG AAGCTACCCTGAGGTGCTGGGCTCTGGGCTTCTATC CTGCTGAGATTATTCTGACCTGGCAGAGAGATGGAGA AGATCAGACTCAAGATGTCGAGTTGGTCGAGACTAGA CCTGCTGGAGATGGCACCTTTCAGAAGTGGGCAGCT GTTGTCGTGCCTAGCGGAGAAGAACAGAGATATACCT GCCATGTGCAGCATGAAGGCCTGCCTGAACCTCTGA | 44 |

TABLE 4-continued

Sequences of antigens used to generate antibodies.
H2A peptide is underlined. The β2M subunit is highlighted bold. His, Avi-, and
Gly-Ser tags are italicized.

| Campaign | Protein AA ID | Sequence | SEQ ID NO: |
|---|---|---|---|
| | | TGCTGAGGTGGAAACAGAGCAGCTTGCCTACTATTCC<br>TATTGGAGGAGGAGGATCTCACCATCATCATCATCAC<br>TGA<br>Mature Protein sequence:<br><u>QARIIPRHLQL</u>*GGGGSGGGGSGGGGS*__IQRTPKIQVYSR__<br>__HPAENGKSNFLNCYVSGFHPSDIEVDLLKNGERIEKVE__<br>__HSDLSFSKDWSFYLLYYTEFTPTEKDEYACRVNHVTLS__<br>__QPKIVKWDRDM__GGGGSGGGGSGGGGSGSHSMRYFS<br>AAVSRPGRGEPRFIAMGYVDDTQFVRFDSDSASPRME<br>PRAPWVEQEGPEYWEEETRNTKAHAQTDRMNLQTLR<br>GYYNQSEASSHTLQWMIGCDLGSDGRLLRGYEQYAYD<br>GKDYLALNEDLRSVVTAADTAAQISKRKCEAANVAEQRR<br>AYLEGTCVEWLHRYLENGKEMLQRADPPKTHVTHHPV<br>FDYEATLRCWALGFYPAEIILTWQRDGEDQTQDVELVE<br>TRPAGDGTFQKWAAVVVPSGEEQRYTCHVQHEGLPEP<br>LMLRWKQSSLPTIPI*GGGGSHHHHHH* | 45 |
| HYB:421,<br>Hybridoma,<br>OMT rats | | DNA sequence, primary transcript:<br>ATGGCTTGGGTGTGGACATTGTTGTTTCTGATGGCTG<br>CTGCTCAATCTATTCAAGCTAGGATCATTCCTAGACAT<br>CTGCAACTCGGAGGCGGAGGCAGCGGAGGAGGAGG<br>ATCTGGAGGAGGAGGATCTATTCAGAGGACACCTAA<br>GATTCAAGTGTACTCTAGACATCCTGCTGAGAACGGC<br>AAGAGCAACTTTCTGAACTGCTATGTGAGCGGCTTTC<br>ATCCTAGCGATATTGAAGTGGATCTGCTGAAAAACGG<br>CGAACGTATTGAAAAAGTGGAACATAGCGATCTGAGC<br>TTTAGCAAAGATTGGAGCTTTTATCTGCTGTATTATAC<br>CGAATTTACCCCTACCGAAAAAGATGAATATGCCTGC<br>AGAGTGAACCATGTGACCCTGAGCCAGCCTAAGATTG<br>TGAAATGGGATAGAGATATGGGAGGAGGAGGCTCTG<br>GAGGAGGAGGATCTGGAGGCGGAGGCAGCGGCTCT<br>CATAGCATGAGATATTTTAGCGCTGCAGTGAGCCGTC<br>CTGGACGTGGAGAACCTAGGTTTATTGCTATGGGCTA<br>TGTGGATGATACCCAGTTTGTGAGGTTTGATAGCGAT<br>AGCGCCTCTCCTAGGATGGAACCTAGAGCTCCCTGG<br>GTGGAACAGGAAGGCCCAGAATATTGGGAAGAAGAA<br>ACCAGGAACACCAAAGCACATGCTCAGACCGATCGTA<br>TGAACCTGCAGACCCTGAGAGGCTATTATAACCAGAG<br>CGAAGCATCTAGCCATACCCTGCAGTGGATGATTGGC<br>TGCGATCTGGGCAGCGATGGCAGACTGCTGAGAGGC<br>TATGAACAGTATGCATATGATGGCAAAGATTATCTGG<br>CACTGAACGAAGATCTGAGGAGCTGGACCGCTGCTG<br>ATACCGCTGCTCAGATTAGCAAGAGGAAGTGCGAAG<br>CTGCTAACGTGGCTGAACAGAGACGCGCATATCTGG<br>AAGGCACCTGCGTGGAATGGCTGCATAGGTATCTGG<br>AAAACGGCAAAGAAATGCTGCAGAGAGCTGATCCTCC<br>TAAAACCCATGTGACCCATCATCCTGTGTTTGATTATG<br>AAGCTACCCTGAGGTGCTGGGCTCTGGGCTTCTATC<br>CTGCTGAGATTATTCTGACCTGGCAGAGAGATGGAGA<br>AGATCAGACTCAAGATGTCGAGTTGGTCGAGACTAGA<br>CCTGCTGGAGATGGCACCTTTCAGAAGTGGGCAGCT<br>GTTGTCGTGCCTAGCGGAGAAGAACAGAGATATACCT<br>GCCATGTGCAGCATGAAGGCCTGCCTGAACCTCTGA<br>TGCTGAGGTGGAAACAGAGCAGCTTGCCTACTATTCC<br>TATTGGAGGAGGAGGATCTCACCATCATCATCATCAC<br>TGA<br>Mature Protein sequence:<br><u>RIIPRHLQL</u>*GGGGSGGGGSGGGGS*__IQRTPKIQVYSRHP__<br>__AENGKSNFLNCYVSGFHPSDIEVDLLKNGERIEKVEHS__<br>__DLSFSKDWSFYLLYYTEFTPTEKDEYACRVNHVTLSQP__<br>__KIVKWDRDM__GGGGSGGGGSGGGGSGSHSMRYFSAA<br>VSRPGRGEPRFIAMGYVDDTQFVRFDSDSASPRMEPR<br>APWVEQEGPEYWEEETRNTKAHAQTDRMNLQTLRGYY<br>NQSEASSHTLQWMIGCDLGSDGRLLRGYEQYAYDGKD<br>YLALNEDLRSWTAADTAAQISKRKCEAANVAEQRRAYL<br>EGTCVEWLHRYLENGKEMLQRADPPKTHVTHHPVFDY<br>EATLRCWALGFYPAEIILTWQRDGEDQTQDVELVETRP<br>AGDGTFQKWAAVVVPSGEEQRYTCHVQHEGLPEPLML<br>RWKQSSLPTIPI*GGGGSHHHHHH* | 46<br><br><br><br><br><br><br><br><br><br><br><br><br><br><br><br><br><br><br><br><br><br><br><br><br><br><br><br><br><br><br><br><br><br><br><br><br><br><br><br>47 |
| HYB:420,<br>Hybridoma,<br>OMT rats | pDR000066413<br>(Mafa-AG-<br>ECD-G4S- | GSHSMRYFYTAVSRPGRGQPRFIAVGYVDDTQFVRFD<br>SDAESPRMEPRAPWVEQEGPEYWDRETQNMKTATQT<br>YQANLRTLLRYYNQSEAGSHTFQKMYGCDLGPDGRLL | 48 |

TABLE 4-continued

Sequences of antigens used to generate antibodies.
H2A peptide is underlined. The β2M subunit is highlighted bold. His, Avi-, and Gly-Ser tags are italicized.

| Campaign | Protein AA ID | Sequence | SEQ ID NO: |
|---|---|---|---|
| | 6XHis-GS-AviT) | RGYEQFAYDGRDYIILNEDLRSWTAADMAAQNTQRKW EAAGAAEQHRTYLEGECLEWLRRYLENGKETLQRADP PKTNVTHHPVSDYEATLRCWALGFYPAEITLTWQRDGE EQTEDTELVETRPTGDGTFQKWAAVVVPSGEEQRYTC HVQHEGLPKPLTLRVVEPSSQSTILIGGGGSHHHHHGS GLNDIFEAQKIEWHE | |
| | pDR000047703 (Cynomolgus monkey beta 2-microglobulin (b2M)) | IQRTPKIQVYSRHPPENGKPNFLNCYVSGFHPSDIEVDL LKNGEKMGKVEHSDLSFSKDWSFYLLYYTEFTPNEKDE YACRVNHVTLSGPRTVKWDRDM | 49 |

For HYB:420, OmniRats were immunized twice weekly for a total of 12 immunization boosts by following a Repetitive Immunizations Multiple Sites (RIMMS) protocol with recombinant human HLA-G1, human HLA-G5 and *cynomolgus* monkey Mafa-AG (homolog of HLA-G1) proteins. A final cell boost was performed using a hHLA-G1 K562 expressing cell line derived from K562 cells (ATCC® CCL-243™). Sera titers were determined via a solid phase ELISA with immunogen being coated on the plate. Draining lymph nodes were harvested for lymphocytes fusion with FO myeloma cells (ATCC® CRL1646™) for hybridoma generation.

For HYB:423, OmniRats were immunized with human HLA-G pDNA (pDR000057441 (Table 3); C>S variant) via the tibialis muscle immediately followed by in vivo electroporation multiple times. Rats received a final boost of a combination of both human and cyno HLA-G over expressing cells. Draining lymph nodes were collected and fused with FO myeloma cells for hybridoma generation.

For HYB:421, OmniRats were immunized with human HLA-G pDNA into each tibialis muscle followed by in-vivo electroporation. Titers were assessed and ranged from 0-800 at Day 25. Rats were rested for several months and then further immunized with pDNA followed by a final boost with K562 cells exogenously overexpressing human HLA-G. Lower draining lymph nodes were used in downstream hybridoma generation.

To select antibody clones for downstream screening, hybridoma supernatants were screened for their abilities to bind cells expressing human HLA-G only and not to cells exogenously expressing HLA-A, HLA-B, and HLA-C, or wild type K562 cells, which do not express cell surface MHC class I antigens. Supernatants which displayed >20-fold higher binding to K562-HLA-G and 10-fold lower binding to K562-HLA-A/B/C (compared to isotype control) were selected for v-region sequencing and cloning. Monoclonal antibodies were generated in both silent format—lacking effector function (IgG4 PAA or IgG1 AAS, where "PAA" indicates P228S, L234A, L235A and "AAS" indicates mutation of L234A, L235A, D265S in EU numbering) and in active format—having normal effector function (IgG1). Antibodies were expressed in the supernatant from CHO cells and isolated by protein A affinity chromatography. Recombinant antibodies were then re-screened (as described above) for selectivity to HLA-G expressing cells as well as for their abilities to bind recombinant HLA-G (MHGW2). From these analyses, a panel of 48 unique v-regions was identified and 8 unique v-regions were selected for further analysis. Two of these 8 v-regions, derived from MHGB688 and MHGB694 were germline-optimized to result in MHGB738 and MHGB737, respectively.

Example 3. Structural Characterization of Anti HLA-G Antibodies

Variable domains of the select anti-HLA-G antibodies were expressed in a Fab format, a scFv format in the VH-linker-VL orientation or a scFv format in VL-linker-VH orientation.

Variable Domains VH, VL and CDRs

Table 5 shows the VH and VL amino acid sequences of selected anti-HLA-G antibodies. Table 6 shows the Kabat HCDR1, HCDR2 and HCDR3 of selected anti-HLA-G antibodies. Table 7 shows the Kabat LCDR1, LCDR2 and LCDR3 of the selected anti-HLA-G antibodies. Table 8 shows the Chothia HCDR1, HCDR2 and HCDR3 of selected anti-HLA-G antibodies. Table 9 shows the Chothia LCDR1, LCDR2 and LCDR3 of the anti-HLA-G. Table 10 shows the IMGT HCDR1, HCDR2 and HCDR3 of selected anti-HLA-G antibodies. Table 11 shows the IMGT LCDR1, LCDR2 and LCDR3 of the anti-HLA-G. Table 12 shows the AbM HCDR1, HCDR2 and HCDR3 of selected anti-HLA-G antibodies. Table 13 shows the AbM LCDR1, LCDR2 and LCDR3 of the anti-HLA-G.

TABLE 5

Variable region sequences of selected anti-HLA-G antibodies.

| Antibody | VH | SEQ ID No: | VL | SEQ ID No: |
|---|---|---|---|---|
| MHGB665 MHGB732 | QVQLQQSGPGLVKPSQTLSLT CASGDSVSSNSAAWNWIRQS PSRGLEWLGRTYYRSKWYND YAVSVKSRITINPDTSKNQISL | 50 | DIVMTQSPDSLAVSLGERATI NCKSSQSVLHSSNNKNYLTW FQQKPGQPPKLLIYWASTRES GVPDRFSGSGSGTDFTLTISSL | 51 |

TABLE 5-continued

Variable region sequences of selected anti-HLA-G antibodies.

| Antibody | VH | SEQ ID No: | VL | SEQ ID No: |
|---|---|---|---|---|
| | QLNSVTPEDTAVYYCAGDRR YGIVGLPFAYWGQGTLVTVSS | | QAEDVAVYYCHQYYSTPPTF GQGTKVEIK | |
| MHGB668 | QVQLQQSGPGLVKPSQTLSLT CAISGDSVSNNSAAWNWIRQS PSRGLEWLGRTYYRSKWYND YAVSVKSRITINPDTSKNQFSL QLNSVTPEDTAVYYCARYGSG TLLFDYWGQGTLVTVSS | 52 | DIVMTQSPDSLAVSLGERATI NCKSSQSVLYSSKNKNYLAW YQQKPGQPPKLLIYWASTRES GVPDRFSGSGSGTDFTLTISSL QAEDVAVYYCQQYYSTFPYT FGQGTKLEIK | 53 |
| MHGB669 | QVQLQQSGPGLVRPSQTLSVT CAISGDSVSSNSASWNWIRQSP SRGLEWLGRTYYRSEWFNDY AVSVKSRVTINPDTSKNQLSL QLNSVIPEDTAVYYCAREARI GVAGKGFDYWGQGTLVTVSS | 54 | DIVMTQSPDSLAVSLGERATI NCKSSQSVLFRSNNKNYLAW FQQKPGQPPKLLIYWASTRES GVPDRFSGSGSGTDFTLTISSL QAEDVAVYYCQQYYSTPRTF GQGTKVEIK | 55 |
| MHGB672 | QVQLQQSGPGLVKPSQTLSLT CAISGDSVSSNRAAWNWIRQT PSRGLEWLGRTYYRSEWYND YAVSVKSRITINPDTSKNQFSL QLNSVTPEDTAVYYCARVRA AVPFDYWGQGTLVTVSS | 56 | DIVMTQSPDSLAVSLGERATI NCKSSQSVLFSSNNKNYLAW YQQKPGQPPNLLIYWASTRES GVPDRFSGSVSGTDFTLTISSL QAEDVAIYYCQQYHSTPWTF GQGTKVEIK | 57 |
| MHGB687 | QLQLQESGPGLVKPSETLSLM CTVSGGSITSSSYYWGWIRQPP GKGLEWIGNIYYSGTTYYNPS LKSRVTISVDTSKNQFSLKLSS VTAADTAVYYCAAGARDFDS WGQGSLVTVSS | 58 | DIVMTQSPDSLAVSLGERATI NCKSSQSVLYSSSNKSYLAW YQQRPGQPPKLLIYWASTRES GVPDRFSGSGSGTDFTLTISSL QAEDVAVYYCQQYYSTPRM YTFGQGTKLEIK | 59 |
| MHGB688 | EVQLLESGPGLVKPSQTLSLTC VISGDSVSSNRAAWNWIRQSP SRGLEWLGRTYYRSKWYNDY AVSVKSRITINSDTSKNQISLQL NSVTPEDTAVYYCARVRPGIP FDYWGQGTPVTVSS | 60 | DIVMTQSPDSLAVSLGERATI NCKSSQSVLFSSNKKNYLAW YQQKPGQPPKLLIYWASTRES GVPDRFSGSGSGTDFTLTISSL QAEDVAVYYCQQYNSTPWT FGQGTKVEIK | 61 |
| MHGB689 | QVQLQQSGPGLVKPSQTLSLT CVISGDSVSSNRAAWNWIRQS PSRGLEWLGRTYYRSKWYND YAVSVKSRITINSDTSKNQISL QLNSVTPEDTAVYYCARVRPG IPFDYWGQGTTVTVSS | 62 | DIQMTQSPDSLAVSLGERATI NCESSQSVLFSSNKKNYLAW YQQKPGQPPKLLIYWASTRES GVPDRFSGSGSGTDFTLTINR LQAEDVAVYYCQQYNSTPW TFGQGTKVEIK | 63 |
| MHGB694 | EVQLLESGGGLVQPGGSLRLS CAASGFTFSSYAMEIWVRQAP GKGLDWVSGISGSGFSTYYVD SVKGRFTISRDNSKHTLYLQM NSLRAEDTAVYYCAKDNLVA GTVFDYWGQGTLVTVSS | 64 | DIQMTQSPSTLSASVGDRVTI TCRASQSISSWLAWYQQKPG KAPKLLIYKASSLESGVPSRFS GSGSGTEFTLTISSLQPDDFAT YYCQQYNSYSLTFGGGTKVD IK | 65 |
| MHGB737 (GL-optimized B694) | EVQLLESGGGLVQPGGSLRLS CAASGFTFSSYAMEIWVRQAP GKGLEWVSGISGSGFSTYYVD SVKGRFTISRDNSKNTLYLQM NSLRAEDTAVYYCAKDNLVA GTVFDYWGQGTLVTVSS | 66 | DIQMTQSPSTLSASVGDRVTI TCRASQSISSWLAWYQQKPG KAPKLLIYKASSLESGVPSRFS GSGSGTEFTLTISSLQPDDFAT YYCQQYNSYSLTFGGGTKVD IK | 67 |
| MHGB738 (GL optimized B688 | QVQLQQSGPGLVKPSQTLSLT CATSGDSVSSNRAAWNWIRQS PSRGLEWLGRTYYRSKWYND YAVSVKSRITINPDTSKNQISL QLNSVTPEDTAVYYCARVRPG IPFDYWGQGTPVTVSS | 68 | DIVMTQSPDSLAVSLGERATI NCKSSQSVLFSSNNKNYLAW YQQKPGQPPKLLIYWASTRES GVPDRFSGSVSGTDFTLTISSL QAEDVAVYYCQQYHSTPWT FGQGTKVEIK | 69 |

TABLE 6

Kabat HCDR1, HCDR2 and HCDR3 of selected anti-HLA-G selected antibodies.

| mAb name | Kabat HCDR1 Sequence | SEQ ID NO: | Kabat HCDR2 Sequence | SEQ ID NO: | Kabat HCDR3 Sequence | SEQ ID NO: |
|---|---|---|---|---|---|---|
| MHGB665 | SNSAAWN | 70 | RTYYRSKWYNDYAVSVKS | 71 | DRRYGIVGLPFAY | 72 |
| MHGB668 | NNSAAWN | 73 | RTYYRSKWYNDYAVSVKS | 71 | YGSGTLLFDY | 74 |
| MHGB669 | SNSASWN | 75 | RTYYRSEWFNDYAVSVKS | 76 | EARIGVAGKGFDY | 77 |
| MHGB672 | SNRAAWN | 78 | RTYYRSEWYNDYAVSVKS | 79 | VRAAVPFDY | 80 |
| MHGB687 | SSSYYWG | 81 | NIYYSGTTYYNPSLKS | 82 | GARDFDS | 83 |
| MHGB688 | SNRAAWN | 78 | RTYYRSKWYNDYAVSVKS | 71 | VRPGIPFDY | 84 |
| MHGB689 | SNRAAWN | 78 | RTYYRSKWYNDYAVSVKS | 71 | VRPGIPFDY | 84 |
| MHGB694 | SYAMH | 85 | GISGSGFSTYYVDSVKG | 86 | DNLVAGTVFDY | 87 |
| MHGB732 | SNSAAWN | 70 | RTYYRSKWYNDYAVSVKS | 71 | DRRYGIVGLPFAY | 72 |
| MHGB737 | SYAMH | 85 | GISGSGFSTYYVDSVKG | 86 | DNLVAGTVFDY | 87 |
| MHGB738 | SNRAAWN | 78 | RTYYRSKWYNDYAVSVKS | 71 | VRPGIPFDY | 84 |

TABLE 7

Kabat LCDR1, LCDR2 and LCDR3 of the selected anti-HLA-G antibodies.

| mAb name | Kabat LCDR1 Sequence | SEQ ID NO: | Kabat LCDR2 Sequence | SEQ ID NO: | Kabat LCDR3 Sequence | SEQ ID NO: |
|---|---|---|---|---|---|---|
| MHGB665 | KSSQSVLHSSNNKNYLT | 88 | WASTRES | 89 | HQYYSTPPT | 90 |
| MHGB668 | KSSQSVLYSSKNKNYLA | 91 | WASTRES | 89 | QQYYSTFPYT | 92 |
| MHGB669 | KSSQSVLFRSNNKNYLA | 93 | WASTRES | 89 | QQYYSTPRT | 94 |
| MHGB672 | KSSQSVLFSSNNKNYLA | 95 | WASTRES | 89 | QQYHSTPWT | 96 |
| MHGB687 | KSSQSVLYSSSNKSYLA | 97 | WASTRES | 89 | QQYYSTPRMYT | 98 |
| MHGB688 | KSSQSVLFSSNKKNYLA | 99 | WASTRES | 89 | QQYNSTPWT | 100 |
| MHGB689 | ESSQSVLFSSNKKNYLA | 101 | WASTRES | 89 | QQYNSTPWT | 100 |
| MHGB694 | RASQSISSWLA | 102 | KASSLES | 103 | QQYNSYSLT | 104 |
| MHGB732 | KSSQSVLHSSNNKNYLT | 88 | WASTRES | 89 | HQYYSTPPT | 90 |
| MHGB737 | RASQSISSWLA | 102 | KASSLES | 103 | QQYNSYSLT | 104 |
| MHGB738 | KSSQSVLFSSNNKNYLA | 95 | WASTRES | 89 | QQYHSTPWT | 96 |

TABLE 8

Chothia HCDR1, HCDR2 and HCDR3 of selected anti-HLA-G antibodies.

| mAb name | Chothia HCDR1 Sequence | SEQ ID NO: | Chothia HCDR2 Sequence | SEQ ID NO: | Chothia HCDR3 Sequence | SEQ ID NO: |
|---|---|---|---|---|---|---|
| MHGB665 | GDSVSSNSA | 105 | YYRSKWY | 106 | DRRYGIVGLPFA | 107 |
| MHGB668 | GDSVSNNSA | 108 | YYRSKWY | 106 | YGSGTLLFD | 109 |

TABLE 8-continued

Chothia HCDR1, HCDR2 and HCDR3 of selected anti-HLA-G antibodies.

| mAb name | Chothia HCDR1 Sequence | SEQ ID NO: | Chothia HCDR2 Sequence | SEQ ID NO: | Chothia HCDR3 Sequence | SEQ ID NO: |
| --- | --- | --- | --- | --- | --- | --- |
| MHGB669 | GDSVSSNSA | 105 | YYRSEWF | 110 | EARIGVAGKGFD | 111 |
| MHGB672 | GDSVSSNRA | 112 | YYRSEWY | 113 | VRAAVPFD | 114 |
| MHGB687 | GGSITSSSY | 115 | YYSGT | 116 | GARDFD | 117 |
| MHGB688 | GDSVSSNRA | 112 | YYRSKWY | 106 | VRPGIPFD | 118 |
| MHGB689 | GDSVSSNRA | 112 | YYRSKWY | 106 | VRPGIPFD | 118 |
| MHGB694 | GFTFSSY | 119 | SGSGFS | 120 | DNLVAGTVFD | 121 |
| MHGB732 | GDSVSSNSA | 105 | YYRSKWY | 106 | DRRYGIVGLPFA | 107 |
| MHGB737 | GFTFSSY | 119 | SGSGFS | 120 | DNLVAGTVFD | 121 |
| MHGB738 | GDSVSSNRA | 112 | YYRSKWY | 106 | VRPGIPFD | 118 |

TABLE 9

Chothia LCDR1, LCDR2 and LCDR3 of the anti-HLA-G antibodies.

| mAb name | Chothia LCDR1 Sequence | SEQ ID NO: | Chothia LCDR2 Sequence | SEQ ID NO: | Chothia LCDR3 Sequence | SEQ ID NO: |
| --- | --- | --- | --- | --- | --- | --- |
| MHGB665 | SQSVLHSSNNKNY | 122 | WAS | 123 | YYSTPP | 124 |
| MHGB668 | SQSVLYSSKNKNY | 125 | WAS | 123 | YYSTFPY | 126 |
| MHGB669 | SQSVLFRSNNKNY | 127 | WAS | 123 | YYSTPR | 128 |
| MHGB672 | SQSVLFSSNNKNY | 129 | WAS | 123 | YHSTPW | 130 |
| MHGB687 | SQSVLYSSSNKSY | 131 | WAS | 123 | YYSTPRMY | 496 |
| MHGB688 | SQSVLFSSNKKNY | 132 | WAS | 123 | YNSTPW | 133 |
| MHGB689 | SQSVLFSSNKKNY | 132 | WAS | 123 | YNSTPW | 133 |
| MHGB694 | SQSISSW | 134 | KAS | 135 | YNSYSL | 136 |
| MHGB732 | SQSVLHSSNNKNY | 122 | WAS | 123 | YYSTPP | 124 |
| MHGB737 | SQSISSW | 134 | KAS | 135 | YNSYSL | 136 |
| MHGB738 | SQSVLFSSNNKNY | 129 | WAS | 123 | YHSTPW | 130 |

TABLE 10

IMGT HCDR1, HCDR2 and HCDR3 of selected anti-HLA-G antibodies.

| mAb name | IMGT HCDR1 Sequence | SEQ ID NO: | IMGT HCDR2 Sequence | SEQ ID NO: | IMGT HCDR3 Sequence | SEQ ID NO: |
| --- | --- | --- | --- | --- | --- | --- |
| MHGB665 | GDSVSSNSAA | 137 | TYYRSKWYN | 138 | AGDRRYGIVGLPFAY | 139 |
| MHGB668 | GDSVSNNSAA | 140 | TYYRSKWYN | 138 | ARYGSGTLLFDY | 141 |
| MHGB669 | GDSVSSNSAS | 142 | TYYRSEWFN | 143 | AREARIGVAGKGFDY | 144 |

TABLE 10-continued

IMGT HCDR1, HCDR2 and HCDR3 of selected anti-HLA-G antibodies.

| | IMGT HCDR1 | | IMGT HCDR2 | | IMGT HCDR3 | |
|---|---|---|---|---|---|---|
| mAb name | Sequence | SEQ ID NO: | Sequence | SEQ ID NO: | Sequence | SEQ ID NO: |
| MHGB672 | GDSVSSNRAA | 145 | TYYRSEWYN | 146 | ARVRAAVPFDY | 147 |
| MHGB687 | GGSITSSSYY | 148 | IYYSGTT | 149 | AAGARDFDS | 150 |
| MHGB688 | GDSVSSNRAA | 145 | TYYRSKWYN | 138 | ARVRPGIPFDY | 151 |
| MHGB689 | GDSVSSNRAA | 145 | TYYRSKWYN | 138 | ARVRPGIPFDY | 151 |
| MHGB694 | GFTFSSYA | 152 | ISGSGFST | 153 | AKDNLVAGTVFDY | 154 |
| MHGB732 | GDSVSSNSAA | 137 | TYYRSKWYN | 138 | AGDRRYGIVGLPFAY | 139 |
| MHGB737 | GFTFSSYA | 152 | ISGSGFST | 153 | AKDNLVAGTVFDY | 154 |
| MHGB738 | GDSVSSNRAA | 145 | TYYRSKWYN | 138 | ARVRPGIPFDY | 151 |

TABLE 11

IMGT LCDR1, LCDR2 and LCDR3 of the anti-HLA-G antibodies.

| | IMGT LCDR1 | | IMGT LCDR2 | | IMGT LCDR3 | |
|---|---|---|---|---|---|---|
| mAb name | Sequence | SEQ ID NO: | Sequence | SEQ ID NO: | Sequence | SEQ ID NO: |
| MHGB665 | QSVLHSSNNKNY | 155 | WAS | 123 | HQYYSTPPT | 156 |
| MHGB668 | QSVLYSSKNKNY | 157 | WAS | 123 | QQYYSTFPYT | 92 |
| MHGB669 | QSVLFRSNNKNY | 159 | WAS | 123 | QQYYSTPRT | 160 |
| MHGB672 | QSVLFSSNNKNY | 161 | WAS | 123 | QQYHSTPWT | 162 |
| MHGB687 | QSVLYSSSNKSY | 163 | WAS | 123 | QQYYSTPRMYT | 164 |
| MHGB688 | QSVLFSSNKKNY | 165 | WAS | 123 | QQYNSTPWT | 166 |
| MHGB689 | QSVLFSSNKKNY | 165 | WAS | 123 | QQYNSTPWT | 166 |
| MHGB694 | QSISSW | 167 | KAS | 135 | QQYNSYSLT | 168 |
| MHGB732 | QSVLHSSNNKNY | 155 | WAS | 123 | HQYYSTPPT | 156 |
| MHGB737 | QSISSW | 167 | KAS | 135 | QQYNSYSLT | 168 |
| MHGB738 | QSVLFSSNNKNY | 161 | WAS | 123 | QQYHSTPWT | 162 |

TABLE 12

AbM HCDR1, HCDR2 and HCDR3 of selected anti-HLA-G antibodies.

| | AbM HCDR1 | | AbM HCDR2 | | AbM HCDR3 | |
|---|---|---|---|---|---|---|
| mAb name | Sequence | SEQ ID NO: | Sequence | SEQ ID NO: | Sequence | SEQ ID NO: |
| MHGB665 | GDSVSSNSAAWN | 169 | RTYYRSKWYND | 170 | DRRYGIVGLPFAY | 171 |
| MHGB668 | GDSVSNNSAAWN | 172 | RTYYRSKWYND | 170 | YGSGTLLFDY | 173 |
| MHGB669 | GDSVSSNSASWN | 174 | RTYYRSEWFND | 175 | EARIGVAGKGFDY | 176 |
| MHGB672 | GDSVSSNRAAWN | 177 | RTYYRSEWYND | 178 | VRAAVPFDY | 179 |

TABLE 12-continued

AbM HCDR1, HCDR2 and HCDR3 of selected anti-HLA-G antibodies.

| mAb name | AbM HCDR1 Sequence | SEQ ID NO: | AbM HCDR2 Sequence | SEQ ID NO: | AbM HCDR3 Sequence | SEQ ID NO: |
|---|---|---|---|---|---|---|
| MHGB687 | GGSITSSSYYWG | 180 | NIYYSGTTY | 181 | GARDFDS | 182 |
| MHGB688 | GDSVSSNRAAWN | 177 | RTYYRSKWYND | 170 | VRPGIPFDY | 183 |
| MHGB689 | GDSVSSNRAAWN | 177 | RTYYRSKWYND | 170 | VRPGIPFDY | 183 |
| MHGB694 | GFTFSSYAMH | 184 | GISGSGFSTY | 185 | DNLVAGTVFDY | 186 |
| MHGB732 | GDSVSSNSAAWN | 169 | RTYYRSKWYND | 170 | DRRYGIVGLPFAY | 171 |
| MHGB737 | GFTFSSYAMH | 184 | GISGSGFSTY | 185 | DNLVAGTVFDY | 186 |
| MHGB738 | GDSVSSNRAAWN | 177 | RTYYRSKWYND | 170 | VRPGIPFDY | 183 |

TABLE 13

AbM LCDR1, LCDR2 and LCDR3 of the anti-HLA-G antibodies.

| mAb name | AbM LCDR1 Sequence | SEQ ID NO: | AbM LCDR2 Sequence | SEQ ID NO: | AbM LCDR3 Sequence | SEQ ID NO: |
|---|---|---|---|---|---|---|
| MHGB665 | KSSQSVLHSSNNKNYLT | 187 | WASTRES | 188 | HQYYSTPPT | 189 |
| MHGB668 | KSSQSVLYSSKNKNYLA | 190 | WASTRES | 188 | QQYYSTFPYT | 191 |
| MHGB669 | KSSQSVLFRSNNKNYLA | 192 | WASTRES | 188 | QQYYSTPRT | 193 |
| MHGB672 | KSSQSVLFSSNNKNYLA | 194 | WASTRES | 188 | QQYHSTPWT | 195 |
| MHGB687 | KSSQSVLYSSSNKSYLA | 196 | WASTRES | 188 | QQYYSTPRMYT | 197 |
| MHGB688 | KSSQSVLFSSNKKNYLA | 198 | WASTRES | 188 | QQYNSTPWT | 199 |
| MHGB689 | ESSQSVLFSSNKKNYLA | 200 | WASTRES | 188 | QQYNSTPWT | 199 |
| MHGB694 | RASQSISSWLA | 201 | KASSLES | 202 | QQYNSYSLT | 203 |
| MHGB732 | KSSQSVLHSSNNKNYLT | 187 | WASTRES | 188 | HQYYSTPPT | 189 |
| MHGB737 | RASQSISSWLA | 201 | KASSLES | 202 | QQYNSYSLT | 203 |
| MHGB738 | KSSQSVLFSSNNKNYLA | 194 | WASTRES | 188 | QQYHSTPWT | 195 |

Germline Optimization

The v-region sequences of the antibodies were analyzed for risks of potential post-translational modifications, for germline fitness, and for their abilities to format as scFv. Two antibodies, MHGB694 and MHGB688 were germline-optimized. The v-region of MHGB694 contained two germline mutations (E46D and N77H), and this v-region was thus was optimized by back-mutation of these residues to the germline sequence at those sites to generate MHGB737 variable region by mutation of D46E and H77N in the VH domain. The v-region of MHGB688 was similarly optimized by mutation of E1Q, L5Q, E6Q, and S71P in the VH domain and by mutation of K30E, G66V in the VL. We found that MHGB688 also contained an "NS" motif at position 92-93 (Kabat) which presents a risk for deamidation. Since the VL of MHGB672 had identical LC-CDRs except that it contained "HS" at positions 92-93, we mutated N92H. This combination of changes resulted in MHGB738.

Fab-Fc and scFvs

The HLA-G specific VH/VL domains were engineered to be expressed either in an antibody format, or as an scFv, or as an arm of a bi-specific (as either Fab-Fc or scFv-Fc). The antibody format and the Fab-Fc bi-specific arm format included a heavy chain as VH-CH1-hinge-CH2-CH3 and the light chain as VL-CL and expressed as IgG2 or IgG4. The scFv-Fc format included either the VH-Linker-VL-Fc or VL-linker-VH-Fc orientations. The linker that is used in the scFv was the linker of SEQ ID NO: 8 described above. The scFv-Fc and Fab-Fc were used to generate bispecific antibodies as described in Example 10.

Table 14 shows the HC amino acid sequences of selected anti-HLA-G antibodies. Table 15 shows the LC amino acid sequences of selected anti-HLA-G antibodies. Table 16 summarizes the HC and LC DNA SEQ ID NOs of selected anti-HLA-G antibodies. Table 17 shows the amino acid sequences of selected scFvs in VH-linker-VL or VL-linker-VH orientation. Table 18 shows the amino acid sequences of selected scFv-Fc. Table 19 shows the scFv and scFv-Fc DNA SEQ ID NOs of selected anti-HLA-G antibodies in the scFv-Fc format.

TABLE 14

Amino acid sequence of the HC (VH-CH1-hinge-CH2-CH3) of selected anti-HLA-G antibodies in a mAb format.

| HLA-G HEAVY CHAIN | SEQ ID NO: | AMINO ACID SEQUENCE |
|---|---|---|
| MHGB665 HC | 204 | QVQLQQSGPGLVKPSQTLSLTCAISGDSVSSNSAAWNWIRQSPSRGLEWLGRT YYRSKWYNDYAVSVKSRITINPDTSKNQISLQLNSVTPEDTAVYYCAGDRRYGIV GLPPFAYWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPS NTKVDKKVEPKSCDKTHTCPPCPAPELLGGPSVFLFPPKPKDTLMISRTPEVTC VVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCL VKGFYPSDIAVEWESNGQPENNYKTTPPVLDSDGSFFLYSKLTVDKSRWQQGN VFSCSVMHEALHNHYTQKSLSLSPGK |
| MHGB668 HC | 205 | QVQLQQSGPGLVKPSQTLSLTCAISGDSVSNNSAAWNWIRQSPSRGLEWLGRT YYRSKWYNDYAVSVKSRITINPDTSKNQFSLQLNSVTPEDTAVYYCARYGSGTL LFDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTK VDKKVEPKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVF SCSVMHEALHNHYTQKSLSLSPGK |
| MHGB669 HC | 206 | QVQLQQSGPGLVRPSQTLSVTCAISGDSVSSNSASWNWIRQSPSRGLEWLGR TYYRSEWFNDYAVSVKSRVTINPDTSKNQLSLQLNSVIPEDTAVYYCAREARIGV AGKGFDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVNHKP SNTKVDKKVEPKSCDKTHTCPPCPAPELLGGPSVFLFPPKPKDTLMISRTPEVT CVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQ GNVFSCSVMHEALHNHYTQKSLSLSPGK |
| MHGB672 HC | 207 | QVQLQQSGPGLVKPSQTLSLTCAISGDSVSSNRAAWNWIRQTPSRGLEWLGRT YYRSEWYNDYAVSVKSRITINPDTSKNQFSLQLNSVTPEDTAVYYCARVRAAVP FDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTK VDKKVEPKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVF SCSVMHEALHNHYTQKSLSLSPGK |
| MHGB687 HC | 208 | QLQLQESGPGLVKPSETLSLMCTVSGGSITSSSYYWGWIRQPPGKGLEWIGNIY YSGTTYYNPSLKSRVTISVDTSKNQFSLKLSSVTAADTAVYYCAAGARDFDSWG QGSLVTVSSASTKGPSVFPLAPSSKSTSGGTAALGCLVKDYFPEPVTVSWNSG ALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHE DPEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK |
| MHGB688 HC | 209 | EVQLLESGPGLVKPSQTLSLTCVISGDSVSSNRAAWNWIRQSPSRGLEWLGRT YYRSKWYNDYAVSVKSRITINSDTSKNQISLQLNSVTPEDTAVYYCARVRPGIPF DYWGQGTPVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGK EYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSC SVMHEALHNHYTQKSLSLSPGK |
| MHGB689 HC | 210 | QVQLQQSGPGLVKPSQTLSLTCVISGDSVSSNRAAWNWIRQSPSRGLEWLGRT YYRSKWYNDYAVSVKSRITINSDTSKNQISLQLNSVTPEDTAVYYCARVRPGIPF DYWGQGTTVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGK EYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSC SVMHEALHNHYTQKSLSLSPGK |
| MHGB694 HC | 211 | EVQLLESGGGLVQPGGSLRLSCAASGFTFSSYAMHWVRQAPGKGLDWVSGIS GSGFSTYYVDSVKGRFTISRDNSKHTLYLQMNSLRAEDTAVYYCAKDNLVAGTV FDYWGQGTLVTVSSASTKGPSVFPLAPSSKSTSGGTAALGCLVKDYFPEPVTV |

TABLE 14-continued

Amino acid sequence of the HC (VH-CH1-hinge-CH2-CH3) of selected anti-HLA-G antibodies in a mAb format.

| HLA-G HEAVY CHAIN | SEQ ID NO: | AMINO ACID SEQUENCE |
|---|---|---|
| | | SWNSGALTSGVHTFPAVLQSSGLYSLSSVVTVPSSSLGTQTYICNVNHKPSNTK VDKKVEPKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVF SCSVMHEALHNHYTQKSLSLSPGK |
| MHGB732 HC | 212 | QVQLQQSGPGLVKPSQTLSLTCAISGDSVSSNSAAWNWIRQSPSRGLEWLGRT YYRSKWYNDYAVSVKSRITINPDTSKNQISLQLNSVTPEDTAVYYCAGDRRYGIV GLPPAYWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPS NTKVDKKVEPKSCDKTHTCPPCPAPELLGGPSVFLFPPKPKDTLMISRTPEVTC VVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCL VKGFYPSDIAVEWESNGQPENNYKTTPPVLDSDGSFFLYSKLTVDKSRWQQGN VFSCSVMHEALHNHYTQKSLSLSPG |
| MHGB737 HC | 213 | EVQLLESGGGLVQPGGSLRLSCAASGFTFSSYAMHWVRQAPGKGLEWVSGIS GSGFSTYYVDSVKGRFTISRDNSKNTLYLQMNSLRAEDTAVYYCAKDNLVAGTV FDYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSNTK VDKKVEPKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVF SCSVMHEALHNHYTQKSLSLSPG |
| MHGB738 HC | 214 | QVQLQQSGPGLVKPSQTLSLTCAISGDSVSSNRAAWNWIRQSPSRGLEWLGRT YYRSKWYNDYAVSVKSRITINPDTSKNQISLQLNSVTPEDTAVYYCARVRPGIPF DYWGQGTPVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGK EYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSC SVMHEALHNHYTQKSLSLSPG |

TABLE 15

Amino acid sequences of the LC (VL-CL) of selected anti-HLA-G antibodies in a mAb (Fab-Fc) format.

| HLA-G LIGHT CHAIN | SEQ ID NO: | AMINO ACID SEQUENCE |
|---|---|---|
| MHGB665 | 215 | DIVMTQSPDSLAVSLGERATINCKSSQSVLHSSNNKNYLTWFQQKPGQP PKLLIYWASTRESGVPDRFSGSGSGTDFTLTISSLQAEDVAVYYCHQYYS TPPTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| MHGB668 | 216 | DIVMTQSPDSLAVSLGERATINCKSSQSVLYSSKNKNYLAWYQQKPGQP PKLLIYWASTRESGVPDRFSGSGSGTDFTLTISSLQAEDVAVYYCQQYYS TFPYTFGQGTKLEIKRTVAAPSVFIFPPSDEQLKSGTASVVCLLNNFYPRE AKVQWKVDNALQSGNSQESVTEQDSKDSTYSLSSTLTLSKADYEKHKVY ACEVTHQGLSSPVTKSFNRGEC |
| MHGB669 | 217 | DIVMTQSPDSLAVSLGERATINCKSSQSVLFRSNNKNYLAWFQQKPGQP PKLLIYWASTRESGVPDRFSGSGSGTDFTLTISSLQAEDVAVYYCQQYYS TPRTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| MHGB672 | 218 | DIVMTQSPDSLAVSLGERATINCKSSQSVLFSSNNKNYLAWYQQKPGQP PNLLIYWASTRESGVPDRFSGSVSGTDFTLTISSLQAEDVAIYYCQQYHST PWTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |

TABLE 15-continued

Amino acid sequences of the LC (VL-CL) of selected anti-HLA-G antibodies in a mAb (Fab-Fc) format.

| HLA-G LIGHT CHAIN | SEQ ID NO: | AMINO ACID SEQUENCE |
|---|---|---|
| MHGB687 | 219 | DIVMTQSPDSLAVSLGERATINCKSSQSVLYSSSNKSYLAWYQQRPGQP PKLLIYWASTRESGVPDRFSGSGSGTDFTLTISSLQAEDVAVYYCQQYYS TPRMYTFGQGTKLEIKRTVAAPSVFIFPPSDEQLKSGTASVVCLLNNFYPR EAKVQWKVDNALQSGNSQESVTEQDSKDSTYSLSSTLTLSKADYEKHKV YACEVTHQGLSSPVTKSFNRGEC |
| MHGB688 | 220 | DIVMTQSPDSLAVSLGERATINCKSSQSVLFSSNKKNYLAWYQQKPGQPP KLLIYWASTRESGVPDRFSGSGSGTDFTLTISSLQAEDVAVYYCQQYNST PWTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| MHGB689 | 221 | DIQMTQSPDSLAVSLGERATINCESSQSVLFSSNKKNYLAWYQQKPGQP PKLLIYWASTRESGVPDRFSGSGSGTDFTLTINRLQAEDVAVYYCQQYNS TPWTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| MHGB694 | 222 | DIQMTQSPSTLSASVGDRVTITCRASQSISSWLAWYQQKPGKAPKWYKA SSLESGVPSRFSGSGSGTEFTLTISSLQPDDFATYYCQQYNSYSLTFGGG TKVDIKRTVAAPSVFIFPPSDEQLKSGTASVVCLLNNFYPREAKVQWKVD NALQSGNSQESVTEQDSKDSTYSLSSTLTLSKADYEKHKVYACEVTHQG LSSPVTKSFNRGEC |
| MHGB732 | 223 | DIVMTQSPDSLAVSLGERATINCKSSQSVLHSSNNKNYLTWFQQKPGQP PKLLIYWASTRESGVPDRFSGSGSGTDFTLTISSLQAEDVAVYYCHQYYS TPPTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| MHGB737 | 224 | DIQMTQSPSTLSASVGDRVTITCRASQSISSWLAWYQQKPGKAPKWYKA SSLESGVPSRFSGSGSGTEFTLTISSLQPDDFATYYCQQYNSYSLTFGGG TKVDIKRTVAAPSVFIFPPSDEQLKSGTASVVCLLNNFYPREAKVQWKVD NALQSGNSQESVTEQDSKDSTYSLSSTLTLSKADYEKHKVYACEVTHQG LSSPVTKSFNRGEC |
| MHGB738 | 225 | DIVMTQSPDSLAVSLGERATINCKSSQSVLFSSNNKNYLAWYQQKPGQP PKLLIYWASTRESGVPDRFSGSVSGTDFTLTISSLQAEDVAVYYCQQYHS TPWTFGQGTKVEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |

TABLE 16

SEQ ID Nos of the cDNA sequences of HC and LC of selected HLA-G antibodies

| Antibody | HC cDNA SEQ ID NO: | LC cDNA SEQ ID NO: |
|---|---|---|
| MHGB665 | 226 | 227 |
| MHGB668 | 228 | 229 |
| MHGB669 | 230 | 231 |
| MHGB672 | 232 | 233 |
| MHGB687 | 234 | 235 |
| MHGB688 | 236 | 237 |
| MHGB689 | 238 | 239 |
| MHGB694 | 240 | 241 |
| MHGB732 | 242 | 243 |
| MHGB737 | 244 | 245 |
| MHGB738 | 246 | 247 |

SEQ ID NO: 226

CAGGTGCAGCTGCAGCAGAGCGGCCCTGGACTGGTGAAGCCCAGCCAGACCCTGAG

CCTGACCTGCGCTATCAGCGGCGATAGCGTGAGCTCCAACAGCGCCGCCTGGAACTGGATCA

GGCAGAGCCCTAGCAGGGGCCTGGAATGGCTGGGCAGGACCTACTACAGGAGCAAGTGGTA

CAACGACTACGCCGTGTCCGTGAAGAGCAGGATCACCATCAACCCCGACACCAGCAAGAAC

CAGATCAGCCTGCAGCTGAACAGCGTGACCCCCGAGGACACCGCCGTGTACTACTGCGCCG

GCGACAGAAGGTACGGCATCGTGGGCCTGCCTTTCGCCTACTGGGGCCAGGGAACCCTGGT

-continued

GACCGTGAGCAGCGCCTCCACCAAGGGCCCATCGGTCTTCCCCCTGGCACCCTCCTCCAAGA

GCACCTCTGGGGGCACAGCGGCCCTGGGCTGCCTGGTCAAGGACTACTTCCCCGAACCGGTG

ACGGTGTCGTGGAACTCAGGCGCCCTGACCAGCGGCGTGCACACCTTCCCGGCTGTCCTACA

GTCCTCAGGACTCTACTCCCTCAGCAGCGTGGTGACCGTGCCCTCCAGCAGCTTGGGCACCC

AGACCTACATCTGCAACGTGAATCACAAGCCCAGCAACACCAAGGTGGACAAGAAAGTTGA

GCCCAAATCTTGTGACAAAACTCACACATGCCCACCGTGCCCAGCACCTGAACTCCTGGGGG

GACCGTCAGTCTTCCTCTTCCCCCCAAAACCCAAGGACACCCTCATGATCTCCCGGACCCCT

GAGGTCACATGCGTGGTGGTGGACGTGAGCCACGAAGACCCTGAGGTCAAGTTCAACTGGT

ACGTGGACGGCGTGGAGGTGCATAATGCCAAGACAAAGCCGCGGGAGGAGCAGTACAACA

GCACGTACCGTGTGGTCAGCGTCCTCACCGTCCTGCACCAGGACTGGCTGAATGGCAAGGAG

TACAAGTGCAAGGTCTCCAACAAAGCCCTCCCAGCCCCCATCGAGAAAACCATCTCCAAAG

CCAAAGGGCAGCCCCGAGAACCACAGGTGTACACCCTGCCCCCATCCCGGGAGGAGATGAC

CAAGAACCAGGTCAGCCTGACCTGCCTGGTCAAAGGCTTCTATCCCAGCGACATCGCCGTGG

AGTGGGAGAGCAATGGGCAGCCGGAGAACAACTACAAGACCACGCCTCCCGTGCTGGACTC

CGACGGCTCCTTCTTCCTCTACAGCAAGCTCACCGTGGACAAGAGCAGGTGGCAGCAGGGG

AACGTCTTCTCATGCTCCGTGATGCATGAGGCTCTGCACAACCACTACACGCAGAAGAGCCT

CTCCCTGTCTCCGGGTAAA

SEQ ID NO: 227
GACATCGTGATGACCCAGAGCCCCGATAGCCTGGCTGTGAGCCTGGGCGAGAGAGC

CACCATCAACTGCAAGAGCAGCCAGAGCGTGCTGCACAGCAGCAACAACAAGAACTACCTG

ACCTGGTTCCAGCAGAAGCCCGGCCAGCCTCCCAAGCTGCTGATCTACTGGGCTAGCACCAG

AGAGTCCGGCGTGCCTGACAGGTTCAGCGGAAGCGGCAGCGGCACCGACTTCACCCTGACC

ATCAGCAGCCTGCAGGCCGAGGACGTGGCCGTGTACTACTGCCACCAGTACTACAGCACCCC

CCCTACCTTTGGCCAGGGCACCAAGGTGGAGATCAAGCGTACGGTGGCTGCACCATCTGTCT

TCATCTTCCCGCCATCTGATGAGCAGTTGAAATCTGGAACTGCCTCTGTTGTGTGCCTGCTGA

ATAACTTCTATCCCAGAGAGGCCAAAGTACAGTGGAAGGTGGATAACGCCCTCCAATCGGG

TAACTCCCAGGAGAGTGTCACAGAGCAGGACAGCAAGGACAGCACCTACAGCCTCAGCAGC

ACCCTGACGCTGAGCAAAGCAGACTACGAGAAACACAAAGTCTACGCCTGCGAAGTCACCC

ATCAGGGCCTGAGCTCGCCCGTCACAAAGAGCTTCAACAGGGGAGAGTGT

SEQ ID NO: 228
CAGGTGCAGCTGCAGCAGAGCGGACCCGGCCTGGTGAAACCCAGCCAGACCCTGAG

CCTGACCTGCGCCATCAGCGGCGACAGCGTGAGCAACAACAGCGCCGCCTGGAACTGGATC

AGGCAGAGCCCCAGCAGAGGCCTGGAATGGCTGGGCAGGACCTACTACAGGAGCAAGTGGT

ACAACGACTACGCCGTGAGCGTGAAGAGCAGGATCACCATCAACCCCGACACCTCCAAGAA

CCAGTTCAGCCTGCAGCTGAACAGCGTGACCCCCGAGGACACCGCCGTGTACTACTGCGCCA

GGTATGGCAGCGGCACCCTGCTGTTCGACTACTGGGGCCAGGGCACCCTGGTGACAGTGAG

CAGCGCCTCCACCAAGGGCCCATCGGTCTTCCCCCTGGCACCCTCCTCCAAGAGCACCTCTG

GGGGCACAGCGGCCCTGGGCTGCCTGGTCAAGGACTACTTCCCCGAACCGGTGACGGTGTC

GTGGAACTCAGGCGCCCTGACCAGCGGCGTGCACACCTTCCCGGCTGTCCTACAGTCCTCAG

GACTCTACTCCCTCAGCAGCGTGGTGACCGTGCCCTCCAGCAGCTTGGGCACCCAGACCTAC

ATCTGCAACGTGAATCACAAGCCCAGCAACACCAAGGTGGACAAGAAAGTTGAGCCCAAAT

-continued

CTTGTGACAAAACTCACACATGCCCACCGTGCCCAGCACCTGAACTCCTGGGGGACCGTCA

GTCTTCCTCTTCCCCCCAAAACCCAAGGACACCCTCATGATCTCCCGGACCCCTGAGGTCAC

ATGCGTGGTGGTGGACGTGAGCCACGAAGACCCTGAGGTCAAGTTCAACTGGTACGTGGAC

GGCGTGGAGGTGCATAATGCCAAGACAAAGCCGCGGGAGGAGCAGTACAACAGCACGTAC

CGTGTGGTCAGCGTCCTCACCGTCCTGCACCAGGACTGGCTGAATGGCAAGGAGTACAAGTG

CAAGGTCTCCAACAAAGCCCTCCCAGCCCCCATCGAGAAAACCATCTCCAAAGCCAAAGGG

CAGCCCCGAGAACCACAGGTGTACACCCTGCCCCCATCCCGGGAGGAGATGACCAAGAACC

AGGTCAGCCTGACCTGCCTGGTCAAAGGCTTCTATCCCAGCGACATCGCCGTGGAGTGGGAG

AGCAATGGGCAGCCGGAGAACAACTACAAGACCACGCCTCCCGTGCTGGACTCCGACGGCT

CCTTCTTCCTCTACAGCAAGCTCACCGTGGACAAGAGCAGGTGGCAGCAGGGGAACGTCTTC

TCATGCTCCGTGATGCATGAGGCTCTGCACAACCACTACACGCAGAAGAGCCTCTCCCTGTC

TCCGGGTAAA

SEQ ID NO: 229

GACATCGTGATGACCCAGAGCCCCGATAGCCTGGCTGTGAGCCTGGGAGAGAGGGC

CACCATCAACTGCAAGAGCAGCCAGAGCGTGCTGTACAGCAGCAAGAACAAGAACTACCTG

GCCTGGTACCAGCAGAAACCCGGCCAGCCCCCCAAGCTGCTGATCTACTGGGCCAGCACAA

GGGAAAGCGGCGTGCCCGACAGATTCAGCGGAAGCGGCAGCGGCACCGACTTCACCCTGAC

CATCAGCAGCCTGCAGGCCGAGGATGTGGCCGTGTACTACTGCCAGCAGTACTACAGCACCT

TCCCCTACACCTTCGGCCAGGGCACCAAGCTGGAGATCAAGCGTACGGTGGCTGCACCATCT

GTCTTCATCTTCCCGCCATCTGATGAGCAGTTGAAATCTGGAACTGCCTCTGTTGTGTGCCTG

CTGAATAACTTCTATCCCAGAGAGGCCAAAGTACAGTGGAAGGTGGATAACGCCCTCCAAT

CGGGTAACTCCCAGGAGAGTGTCACAGAGCAGGACAGCAAGGACAGCACCTACAGCCTCAG

CAGCACCCTGACGCTGAGCAAAGCAGACTACGAGAAACACAAAGTCTACGCCTGCGAAGTC

ACCCATCAGGGCCTGAGCTCGCCCGTCACAAAGAGCTTCAACAGGGGAGAGTGT

SEQ ID NO: 230

CAGGTGCAGCTGCAGCAGAGCGGACCCGGACTGGTGAGACCCAGCCAGACCCTGAG

CGTGACCTGCGCCATCAGCGGCGACAGCGTGAGCAGCAACAGCGCCAGCTGGAACTGGATC

AGGCAGAGCCCCAGCAGAGGCCTGGAGTGGCTGGGAAGGACATACTACAGGAGCGAGTGG

TTCAACGACTACGCCGTGAGCGTGAAGAGCAGGGTGACCATCAACCCCGACACCAGCAAGA

ACCAGCTGAGCCTGCAGCTGAACAGCGTGATCCCCGAGGACACCGCCGTGTACTACTGCGCC

AGAGAGGCCAGAATCGGCGTGGCCGGCAAAGGCTTCGACTACTGGGGCCAGGGCACCCTGG

TGACAGTGTCCAGCGCCTCCACCAAGGGCCCATCGGTCTTCCCCCTGGCACCCTCCTCCAAG

AGCACCTCTGGGGGCACAGCGGCCCTGGGCTGCCTGGTCAAGGACTACTTCCCCGAACCGGT

GACGGTGTCGTGGAACTCAGGCGCCCTGACCAGCGGCGTGCACACCTTCCCGGCTGTCCTAC

AGTCCTCAGGACTCTACTCCCTCAGCAGCGTGGTGACCGTGCCCTCCAGCAGCTTGGGCACC

CAGACCTACATCTGCAACGTGAATCACAAGCCCAGCAACACCAAGGTGGACAAGAAAGTTG

AGCCCAAATCTTGTGACAAAACTCACACATGCCCACCGTGCCCAGCACCTGAACTCCTGGGG

GGACCGTCAGTCTTCCTCTTCCCCCCAAAACCCAAGGACACCCTCATGATCTCCCGGACCCC

TGAGGTCACATGCGTGGTGGTGGACGTGAGCCACGAAGACCCTGAGGTCAAGTTCAACTGG

TACGTGGACGGCGTGGAGGTGCATAATGCCAAGACAAAGCCGCGGGAGGAGCAGTACAAC

AGCACGTACCGTGTGGTCAGCGTCCTCACCGTCCTGCACCAGGACTGGCTGAATGGCAAGGA

GTACAAGTGCAAGGTCTCCAACAAAGCCCTCCCAGCCCCCATCGAGAAAACCATCTCCAAA

-continued

GCCAAAGGGCAGCCCCGAGAACCACAGGTGTACACCCTGCCCCCATCCCGGGAGGAGATGA
CCAAGAACCAGGTCAGCCTGACCTGCCTGGTCAAAGGCTTCTATCCCAGCGACATCGCCGTG
GAGTGGGAGAGCAATGGGCAGCCGGAGAACAACTACAAGACCACGCCTCCCGTGCTGGACT
CCGACGGCTCCTTCTTCCTCTACAGCAAGCTCACCGTGGACAAGAGCAGGTGGCAGCAGGG
GAACGTCTTCTCATGCTCCGTGATGCATGAGGCTCTGCACAACCACTACACGCAGAAGAGCC
TCTCCCTGTCTCCGGGTAAA

SEQ ID NO: 231
GACATCGTGATGACCCAGAGCCCTGACTCCCTGGCTGTGAGCCTGGGCGAGAGAGCC
ACCATCAACTGCAAGAGCAGCCAGAGCGTGCTGTTCAGGAGCAACAACAAGAACTACCTGG
CCTGGTTCCAGCAGAAGCCCGGCCAGCCTCCCAAGCTGCTGATCTACTGGGCCAGCACCAGA
GAGAGCGGCGTGCCCGATAGATTTAGCGGCAGCGGCAGCGGCACCGACTTTACCCTGACCA
TCAGCTCCCTGCAGGCCGAGGATGTGGCCGTGTACTACTGCCAGCAGTACTACAGCACCCCC
AGAACCTTCGGCCAGGGCACCAAGGTGGAGATCAAGCGTACGGTGGCTGCACCATCTGTCTT
CATCTTCCCGCCATCTGATGAGCAGTTGAAATCTGGAACTGCCTCTGTTGTGTGCCTGCTGAA
TAACTTCTATCCCAGAGAGGCCAAAGTACAGTGGAAGGTGGATAACGCCCTCCAATCGGGT
AACTCCCAGGAGAGTGTCACAGAGCAGGACAGCAAGGACAGCACCTACAGCCTCAGCAGCA
CCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGT

SEQ ID NO: 232
CAGGTGCAGCTGCAGCAGAGCGGACCTGGCCTGGTGAAGCCCAGCCAGACCCTGAG
CCTGACATGCGCCATCAGCGGCGACAGCGTGAGCAGCAATAGGGCCGCCTGGAACTGGATC
AGGCAGACCCCTAGCAGGGGCCTGGAATGGCTGGGCAGGACATACTACAGGAGCGAGTGGT
ACAACGACTACGCCGTGTCCGTGAAGAGCAGGATCACCATCAACCCCGACACCAGCAAGAA
CCAGTTCAGCCTGCAGCTGAACAGCGTGACCCCCGAGGACACCGCCGTGTACTACTGCGCCA
GAGTGAGAGCCGCCGTGCCTTTCGACTACTGGGGCCAGGGCACCCTGGTGACAGTGAGCAG
CGCCTCCACCAAGGGCCCATCGGTCTTCCCCCTGGCACCCTCCTCCAAGAGCACCTCTGGGG
GCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACT
CTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTG
TGACAAAACTCACACATGCCCACCGTGCCCAGCACCTGAACTCCTGGGGGGACCGTCAGTCT
TCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCG
TGGAGGTGCATAATGCCAAGACAAAGCCGCGGGAGGAGCAGTACAACAGCACGTACCGTGT
GGTCAGCGTCCTCACCGTCCTGCACCAGGACTGGCTGAATGGCAAGGAGTACAAGTGCAAG
GTCTCCAACAAAGCCCTCCCAGCCCCCATCGAGAAAACCATCTCCAAAGCCAAAGGGCAGC
CCCGAGAACCACAGGTGTACACCCTGCCCCCATCCCGGGAGGAGATGACCAAGAACCAGGT
CAGCCTGACCTGCCTGGTCAAAGGCTTCTATCCCAGCGACATCGCCGTGGAGTGGGAGAGCA
ATGGGCAGCCGGAGAACAACTACAAGACCACGCCTCCCGTGCTGGACTCCGACGGCTCCTTC

-continued
TTCCTCTACAGCAAGCTCACCGTGGACAAGAGCAGGTGGCAGCAGGGGAACGTCTTCTCATG

CTCCGTGATGCATGAGGCTCTGCACAACCACTACACGCAGAAGAGCCTCTCCCTGTCTCCGG

GTAAA

SEQ ID NO: 233
GACATCGTGATGACCCAGAGCCCCGATAGCCTGGCTGTGAGCCTGGGCGAGAGGGC

CACCATCAACTGCAAGAGCAGCCAGAGCGTGCTGTTTTCCAGCAACAACAAGAACTACCTG

GCCTGGTACCAGCAGAAACCCGGCCAGCCCCCCAACCTGCTGATCTACTGGGCCAGCACCA

GAGAAAGCGGCGTGCCCGACAGGTTTAGCGGCAGCGTGAGCGGCACCGACTTCACCCTGAC

CATCAGCAGCCTGCAGGCCGAGGACGTGGCCATCTACTACTGCCAGCAGTACCACAGCACC

CCCTGGACATTCGGCCAGGGCACCAAGGTGGAGATCAAGCGTACGGTGGCTGCACCATCTG

TCTTCATCTTCCCGCCATCTGATGAGCAGTTGAAATCTGGAACTGCCTCTGTTGTGTGCCTGC

TGAATAACTTCTATCCCAGAGAGGCCAAAGTACAGTGGAAGGTGGATAACGCCCTCCAATC

GGGTAACTCCCAGGAGAGTGTCACAGAGCAGGACAGCAAGGACAGCACCTACAGCCTCAGC

AGCACCCTGACGCTGAGCAAAGCAGACTACGAGAAACACAAAGTCTACGCCTGCGAAGTCA

CCCATCAGGGCCTGAGCTCGCCCGTCACAAAGAGCTTCAACAGGGGAGAGTGT

SEQ ID NO: 234
CAGCTGCAGCTGCAGGAGAGCGGCCCTGGACTGGTGAAGCCCAGCGAGACCCTGAG

CCTGATGTGCACCGTGAGCGGCGGCAGCATCACCAGCAGCAGCTACTACTGGGGATGGATC

AGACAGCCCCCTGGCAAGGGCCTGGAGTGGATCGGCAACATCTACTACAGCGGCACCACCT

ACTACAACCCCAGCCTGAAGAGCAGGGTGACCATCAGCGTGGACACCAGCAAGAACCAGTT

CAGCCTGAAGCTGAGCAGCGTGACAGCTGCCGACACCGCCGTGTACTACTGTGCCGCCGGA

GCCAGAGACTTCGACAGCTGGGGACAGGGCAGCCTGGTGACCGTGTCCAGCGCCTCCACCA

AGGGCCCATCGGTCTTCCCCCTGGCACCCTCCTCCAAGAGCACCTCTGGGGGCACAGCGGCC

CTGGGCTGCCTGGTCAAGGACTACTTCCCCGAACCGGTGACGGTGTCGTGGAACTCAGGCGC

CCTGACCAGCGGCGTGCACACCTTCCCGGCTGTCCTACAGTCCTCAGGACTCTACTCCCTCA

GCAGCGTGGTGACCGTGCCCTCCAGCAGCTTGGGCACCCAGACCTACATCTGCAACGTGAAT

CACAAGCCCAGCAACACCAAGGTGGACAAGAAAGTTGAGCCCAAATCTTGTGACAAAACTC

ACACATGCCCACCGTGCCCAGCACCTGAACTCCTGGGGGGACCGTCAGTCTTCCTCTTCCCC

CCAAAACCCAAGGACACCCTCATGATCTCCCGGACCCCTGAGGTCACATGCGTGGTGGTGGA

CGTGAGCCACGAAGACCCTGAGGTCAAGTTCAACTGGTACGTGGACGGCGTGGAGGTGCAT

AATGCCAAGACAAAGCCGCGGGAGGAGCAGTACAACAGCACGTACCGTGTGGTCAGCGTCC

TCACCGTCCTGCACCAGGACTGGCTGAATGGCAAGGAGTACAAGTGCAAGGTCTCCAACAA

AGCCCTCCCAGCCCCCATCGAGAAAACCATCTCCAAAGCCAAAGGGCAGCCCCGAGAACCA

CAGGTGTACACCCTGCCCCCATCCCGGGAGGAGATGACCAAGAACCAGGTCAGCCTGACCT

GCCTGGTCAAAGGCTTCTATCCCAGCGACATCGCCGTGGAGTGGGAGAGCAATGGGCAGCC

GGAGAACAACTACAAGACCACGCCTCCCGTGCTGGACTCCGACGGCTCCTTCTTCCTCTACA

GCAAGCTCACCGTGGACAAGAGCAGGTGGCAGCAGGGGAACGTCTTCTCATGCTCCGTGAT

GCATGAGGCTCTGCACAACCACTACACGCAGAAGAGCCTCTCCCTGTCTCCGGGTAAA

SEQ ID NO: 235
GACATCGTGATGACCCAGAGCCCTGATAGCCTGGCCGTGAGCCTGGGAGAGAGAGC

CACCATCAACTGCAAGTCCTCCCAGAGCGTGCTGTACAGCTCCAGCAACAAGAGCTACCTGG

CCTGGTACCAGCAGAGGCCCGGACAGCCTCCCAAGCTGCTGATCTACTGGGCCAGCACCAG

-continued

AGAGAGCGGCGTGCCTGACAGGTTTAGCGGCTCCGGCTCCGGCACCGACTTTACCCTGACCA

TCAGCAGCCTGCAGGCCGAGGATGTGGCCGTGTACTACTGCCAGCAGTACTACAGCACCCCC

AGGATGTACACCTTCGGCCAGGGCACCAAGCTGGAGATCAAGCGTACGGTGGCTGCACCAT

CTGTCTTCATCTTCCCGCCATCTGATGAGCAGTTGAAATCTGGAACTGCCTCTGTTGTGTGCC

TGCTGAATAACTTCTATCCCAGAGAGGCCAAAGTACAGTGGAAGGTGGATAACGCCCTCCA

ATCGGGTAACTCCCAGGAGAGTGTCACAGAGCAGGACAGCAAGGACAGCACCTACAGCCTC

AGCAGCACCCTGACGCTGAGCAAAGCAGACTACGAGAAACACAAAGTCTACGCCTGCGAAG

TCACCCATCAGGGCCTGAGCTCGCCCGTCACAAAGAGCTTCAACAGGGGAGAGTGT

SEQ ID NO: 236
GAGGTGCAGCTGTTGGAGTCAGGTCCAGGACTGGTGAAGCCCTCGCAGACCCTCTCA

CTCACCTGTGTCATCTCCGGGGACAGTGTCTCTAGCAACAGAGCTGCTTGGAACTGGATCAG

GCAGTCCCCATCGAGAGGCCTTGAGTGGCTGGGAAGGACATACTACAGGTCCAAGTGGTAT

AATGATTATGCAGTATCTGTGAAAAGTCGAATAACCATCAATTCAGACACATCCAAGAACCA

GATCTCCCTGCAGTTGAACTCTGTGACTCCCGAGGACACGGCTGTGTATTACTGTGCAAGAG

TGAGACCGGGGATCCCATTTGACTACTGGGGCCAGGGAACCCCGGTCACCGTCTCCTCAGCC

TCCACCAAGGGCCCATCGGTCTTCCCCCTGGCACCCTCCTCCAAGAGCACCTCTGGGGGCAC

AGCGGCCCTGGGCTGCCTGGTCAAGGACTACTTCCCCGAACCGGTGACGGTGTCGTGGAACT

CAGGCGCCCTGACCAGCGGCGTGCACACCTTCCCGGCTGTCCTACAGTCCTCAGGACTCTAC

TCCCTCAGCAGCGTGGTGACCGTGCCCTCCAGCAGCTTGGGCACCCAGACCTACATCTGCAA

CGTGAATCACAAGCCCAGCAACACCAAGGTGGACAAGAAAGTTGAGCCCAAATCTTGTGAC

AAAACTCACACATGCCCACCGTGCCCAGCACCTGAACTCCTGGGGGGACCGTCAGTCTTCCT

CTTCCCCCCAAAACCCAAGGACACCCTCATGATCTCCCGGACCCCTGAGGTCACATGCGTGG

TGGTGGACGTGAGCCACGAAGACCCTGAGGTCAAGTTCAACTGGTACGTGGACGGCGTGGA

GGTGCATAATGCCAAGACAAAGCCGCGGGAGGAGCAGTACAACAGCACGTACCGTGTGGTC

AGCGTCCTCACCGTCCTGCACCAGGACTGGCTGAATGGCAAGGAGTACAAGTGCAAGGTCT

CCAACAAAGCCCTCCCAGCCCCCATCGAGAAAACCATCTCCAAAGCCAAAGGGCAGCCCCG

AGAACCACAGGTGTACACCCTGCCCCCATCCCGGGAGGAGATGACCAAGAACCAGGTCAGC

CTGACCTGCCTGGTCAAAGGCTTCTATCCCAGCGACATCGCCGTGGAGTGGGAGAGCAATGG

GCAGCCGGAGAACAACTACAAGACCACGCCTCCCGTGCTGGACTCCGACGGCTCCTTCTTCC

TCTACAGCAAGCTCACCGTGGACAAGAGCAGGTGGCAGCAGGGGAACGTCTTCTCATGCTC

CGTGATGCATGAGGCTCTGCACAACCACTACACGCAGAAGAGCCTCTCCCTGTCTCCGGGTA

AA

SEQ ID NO: 237
GACATCGTGATGACCCAGTCTCCAGACTCCCTGGCTGTGTCTCTGGGCGAGAGGGCC

ACCATCAACTGCAAGTCCAGCCAGAGTGTTTTATTCAGCTCCAACAAAAAGAACTACTTAGC

TTGGTACCAGCAGAAACCAGGACAGCCCCCTAAGCTGCTCATTTACTGGGCATCTACCCGGG

AATCCGGGGTCCCTGACCGATTCAGTGGCAGCGGGTCTGGGACAGATTTCACTCTCACCATC

AGCAGCCTGCAGGCTGAAGATGTGGCAGTTTATTACTGTCAGCAATATAATAGTACTCCGTG

GACGTTCGGCCAAGGGACCAAGGTGGAGATCAAACGTACGGTGGCTGCACCATCTGTCTTC

ATCTTCCCGCCATCTGATGAGCAGTTGAAATCTGGAACTGCCTCTGTTGTGTGCCTGCTGAAT

AACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCAC

```
CCTGACGCTGAGCAAAGCAGACTACGAGAAACACAAAGTCTACGCCTGCGAAGTCACCCAT

CAGGGCCTGAGCTCGCCCGTCACAAAGAGCTTCAACAGGGGAGAGTGT
```

SEQ ID NO: 238
```
CAGGTACAGCTGCAGCAGTCAGGTCCAGGACTGGTGAAGCCCTCGCAGACCCTCTCA

CTCACCTGTGTCATCTCCGGGGACAGTGTCTCTAGCAACAGAGCTGCCTGGAACTGGATCAG

GCAGTCCCCATCGAGAGGCCTTGAGTGGCTGGGAAGGACATACTACAGGTCCAAGTGGTAT

AATGATTATGCAGTTTCTGTGAAAAGTCGAATAACCATCAATTCAGACACATCCAAGAACCA

GATCTCCCTGCAGTTGAACTCTGTGACTCCCGAGGACACGGCTGTGTATTACTGTGCAAGAG

TGAGACCGGGGATCCCTTTTGACTACTGGGGCCAGGGAACCACGGTCACCGTCTCCTCAGCC

TCCACCAAGGGCCCATCGGTCTTCCCCCTGGCACCCTCCTCCAAGAGCACCTCTGGGGGCAC

AGCGGCCCTGGGCTGCCTGGTCAAGGACTACTTCCCCGAACCGGTGACGGTGTCGTGGAACT

CAGGCGCCCTGACCAGCGGCGTGCACACCTTCCCGGCTGTCCTACAGTCCTCAGGACTCTAC

TCCCTCAGCAGCGTGGTGACCGTGCCCTCCAGCAGCTTGGGCACCCAGACCTACATCTGCAA

CGTGAATCACAAGCCCAGCAACACCAAGGTGGACAAGAAAGTTGAGCCCAAATCTTGTGAC

AAAACTCACACATGCCCACCGTGCCCAGCACCTGAACTCCTGGGGGGACCGTCAGTCTTCCT

CTTCCCCCCAAAACCCAAGGACACCCTCATGATCTCCCGGACCCCTGAGGTCACATGCGTGG

TGGTGGACGTGAGCCACGAAGACCCTGAGGTCAAGTTCAACTGGTACGTGGACGGCGTGGA

GGTGCATAATGCCAAGACAAAGCCGCGGGAGGAGCAGTACAACAGCACGTACCGTGTGGTC

AGCGTCCTCACCGTCCTGCACCAGGACTGGCTGAATGGCAAGGAGTACAAGTGCAAGGTCT

CCAACAAAGCCCTCCCAGCCCCCATCGAGAAAACCATCTCCAAAGCCAAAGGGCAGCCCCG

AGAACCACAGGTGTACACCCTGCCCCCATCCCGGGAGGAGATGACCAAGAACCAGGTCAGC

CTGACCTGCCTGGTCAAAGGCTTCTATCCCAGCGACATCGCCGTGGAGTGGGAGAGCAATGG

GCAGCCGGAGAACAACTACAAGACCACGCCTCCCGTGCTGGACTCCGACGGCTCCTTCTTCC

TCTACAGCAAGCTCACCGTGGACAAGAGCAGGTGGCAGCAGGGGAACGTCTTCTCATGCTC

CGTGATGCATGAGGCTCTGCACAACCACTACACGCAGAAGAGCCTCTCCCTGTCTCCGGGTA

AA
```

SEQ ID NO: 239
```
GACATCCAGATGACCCAGTCTCCAGACTCCCTGGCTGTGTCTCTGGGCGAGAGGGCC

ACCATCAACTGCGAGTCCAGCCAGAGTGTTTTATTCAGCTCCAACAAAAAGAACTACTTAGC

TTGGTACCAGCAGAAACCAGGACAGCCCCCTAAGCTGCTCATTTACTGGGCATCTACCCGGG

AATCCGGGGTCCCTGACCGATTCAGTGGCAGCGGGTCTGGGACAGATTTCACTCTCACCATC

AACCGCCTGCAGGCTGAAGATGTGGCAGTTTATTACTGTCAGCAATATAATAGTACTCCGTG

GACGTTCGGCCAAGGGACCAAGGTGGAGATCAAACGTACGGTGGCTGCACCATCTGTCTTC

ATCTTCCCGCCATCTGATGAGCAGTTGAAATCTGGAACTGCCTCTGTTGTGTGCCTGCTGAAT

AACTTCTATCCCAGAGAGGCCAAAGTACAGTGGAAGGTGGATAACGCCCTCCAATCGGGTA

ACTCCCAGGAGAGTGTCACAGAGCAGGACAGCAAGGACAGCACCTACAGCCTCAGCAGCAC

CCTGACGCTGAGCAAAGCAGACTACGAGAAACACAAAGTCTACGCCTGCGAAGTCACCCAT

CAGGGCCTGAGCTCGCCCGTCACAAAGAGCTTCAACAGGGGAGAGTGT
```

SEQ ID NO: 240
```
GAGGTGCAGCTGTTGGAGTCTGGGGGAGGCTTGGTACAGCCTGGGGGGTCCCTGAG

ACTCTCCTGTGCAGCCTCTGGATTCACCTTTAGCAGCTATGCCATGCACTGGGTCCGCCAGGC

CCCAGGGAAGGGGCTGGACTGGGTCTCAGGTATTAGTGGTAGTGGCTTTAGCACATACTATG
```

-continued

TAGACTCCGTGAAGGGCCGGTTCACCATCTCCAGAGACAATTCCAAGCACACGCTGTATCTG

CAAATGAACAGCCTGAGAGCCGAGGACACGGCCGTATATTACTGTGCGAAAGATAATTTAG

TGGCTGGTACCGTCTTTGACTACTGGGGCCAGGGAACCCTGGTCACCGTCTCCTCAGCCTCC

ACCAAGGGCCCATCGGTCTTCCCCCTGGCACCCTCCTCCAAGAGCACCTCTGGGGGCACAGC

GGCCCTGGGCTGCCTGGTCAAGGACTACTTCCCCGAACCGGTGACGGTGTCGTGGAACTCAG

GCGCCCTGACCAGCGGCGTGCACACCTTCCCGGCTGTCCTACAGTCCTCAGGACTCTACTCC

CTCAGCAGCGTGGTGACCGTGCCCTCCAGCAGCTTGGGCACCCAGACCTACATCTGCAACGT

GAATCACAAGCCCAGCAACACCAAGGTGGACAAGAAAGTTGAGCCCAAATCTTGTGACAAA

ACTCACACATGCCCACCGTGCCCAGCACCTGAACTCCTGGGGGGACCGTCAGTCTTCCTCTT

CCCCCCAAAACCCAAGGACACCCTCATGATCTCCCGGACCCCTGAGGTCACATGCGTGGTGG

TGGACGTGAGCCACGAAGACCCTGAGGTCAAGTTCAACTGGTACGTGGACGGCGTGGAGGT

GCATAATGCCAAGACAAAGCCGCGGGAGGAGCAGTACAACAGCACGTACCGTGTGGTCAGC

GTCCTCACCGTCCTGCACCAGGACTGGCTGAATGGCAAGGAGTACAAGTGCAAGGTCTCCA

ACAAAGCCCTCCCAGCCCCCATCGAGAAAACCATCTCCAAAGCCAAAGGGCAGCCCCGAGA

ACCACAGGTGTACACCCTGCCCCCATCCCGGGAGGAGATGACCAAGAACCAGGTCAGCCTG

ACCTGCCTGGTCAAAGGCTTCTATCCCAGCGACATCGCCGTGGAGTGGGAGAGCAATGGGC

AGCCGGAGAACAACTACAAGACCACGCCTCCCGTGCTGGACTCCGACGGCTCCTTCTTCCTC

TACAGCAAGCTCACCGTGGACAAGAGCAGGTGGCAGCAGGGGAACGTCTTCTCATGCTCCG

TGATGCATGAGGCTCTGCACAACCACTACACGCAGAAGAGCCTCTCCCTGTCTCCGGGTAAA

SEQ ID NO: 241
GACATCCAGATGACCCAGTCTCCTTCCACCCTGTCTGCATCTGTAGGAGACAGAGTC

ACCATCACTTGCCGGGCCAGTCAGAGTATTAGTAGCTGGTTGGCCTGGTATCAGCAGAAACC

AGGGAAAGCCCCTAAGCTCCTGATCTATAAGGCGTCTAGTTTAGAAAGTGGGGTCCCATCAA

GGTTCAGCGGCAGTGGATCTGGGACAGAATTCACTCTCACCATCAGCAGCCTGCAGCCTGAT

GATTTTGCAACTTATTACTGCCAACAGTATAATAGTTATTCGCTCACTTTCGGCGGAGGGACC

AAGGTGGATATCAAACGTACGGTGGCTGCACCATCTGTCTTCATCTTCCCGCCATCTGATGA

GCAGTTGAAATCTGGAACTGCCTCTGTTGTGTGCCTGCTGAATAACTTCTATCCCAGAGAGG

CCAAAGTACAGTGGAAGGTGGATAACGCCCTCCAATCGGGTAACTCCCAGGAGAGTGTCAC

AGAGCAGGACAGCAAGGACAGCACCTACAGCCTCAGCAGCACCCTGACGCTGAGCAAAGCA

GACTACGAGAAACACAAAGTCTACGCCTGCGAAGTCACCCATCAGGGCCTGAGCTCGCCCG

TCACAAAGAGCTTCAACAGGGGAGAGTGT

SEQ ID NO: 242
CAAGTACAACTGCAACAAAGTGGTCCTGGGCTCGTGAAGCCTTCCCAGACTCTCAGC

CTCACATGCGCTATAAGTGGGGATTCTGTTTCCTCAAATTCAGCAGCCTGGAATTGGATACG

ACAGTCTCCATCCCGTGGCCTTGAGTGGCTTGGTAGAACTTATTACCGATCCAAGTGGTACA

ATGATTACGCCGTTTCAGTGAAGTCCCGCATTACTATTAATCCCGACACATCTAAGAATCAA

ATTTCATTGCAACTGAATAGCGTAACACCCGAAGATACAGCAGTTTATTATTGTGCAGGTGA

TCGACGCTACGGCATAGTGGGACTTCCTTTCGCCTATTGGGCCAAGGGACACTGGTCACTG

TGTCATCCGCCTCCACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGAACCGGTGACGGT

GTCGTGGAACTCAGGCGCCCTGACCAGCGGCGTGCACACCTTCCCGGCTGTCCTACAGTCCT

-continued

CAGGACTCTACTCCCTCAGCAGCGTGGTGACCGTGCCCTCCAGCAGCTTGGGCACCCAGACC

TACATCTGCAACGTGAATCACAAGCCCAGCAACACCAAGGTGGACAAGAAAGTTGAGCCCA

AATCTTGTGACAAAACTCACACATGTCCACCGTGCCCAGCACCTGAACTGCTGGGGGGACCG

TCAGTCTTCCTCTTCCCCCCAAAACCCAAGGACACCCTCATGATCTCCCGGACCCCTGAGGTC

ACATGCGTGGTGGTGGACGTGAGCCACGAAGACCCTGAGGTCAAGTTCAACTGGTACGTGG

ACGGCGTGGAGGTGCATAATGCCAAGACAAAGCCGCGGGAGGAGCAGTACAACAGCACGT

ACCGTGTGGTCAGCGTCCTCACCGTCCTGCACCAGGACTGGCTGAATGGCAAGGAGTACAA

GTGCAAGGTCTCCAACAAAGCCCTCCCAGCCCCCATCGAGAAAACCATCTCCAAAGCCAAA

GGGCAGCCCCGAGAACCACAGGTGTACACCCTGCCCCCATCCCGGGAGGAGATGACCAAGA

ACCAGGTCAGCCTGACCTGCCTGGTCAAAGGCTTCTATCCCAGCGACATCGCCGTGGAGTGG

GAGAGCAATGGGCAGCCGGAGAACAACTACAAGACCACGCCTCCCGTGCTGGACTCCGACG

GCTCCTTCTTCCTCTACAGCAAGCTCACCGTGGACAAGTCTAGATGGCAGCAGGGGAACGTC

TTCTCATGCTCCGTGATGCATGAGGCTCTGCACAACCACTACACGCAGAAGAGCCTCTCCCT

GTCTCCGGGT

SEQ ID NO: 243
GACATCGTAATGACACAGTCACCAGATTCATTGGCAGTTAGTCTGGGTGAAAGGGCA

ACAATCAACTGCAAGTCTTCTCAGAGTGTACTGCATAGTTCTAACAATAAGAACTACCTTAC

CTGGTTTCAACAGAAACCAGGTCAGCCCCCCAAGTTGCTGATTTACTGGGCAAGCACCCGCG

AATCCGGCGTTCCCGATCGATTTTCAGGTTCCGGGAGTGGGACCGACTTTACCTTGACCATCT

CTTCCTTGCAGGCCGAAGATGTAGCCGTCTATTACTGCCATCAGTATTACTCTACTCCCCCA

CATTCGGTCAAGGTACAAAAGTTGAGATAAAACGGACAGTGGCCGCTCCTTCCGTGTTCATC

TTCCCACCTTCCGACGAGCAGCTGAAGTCCGGCACAGCTTCTGTCGTGTGCCTGCTGAACAA

CTTCTACCCTCGGGAAGCCAAGGTGCAGTGGAAGGTGGACAATGCCCTGCAGTCCGGCAAC

TCCCAAGAGTCTGTGACCGAGCAGGACTCCAAGGACAGCACCTACAGCCTGTCCTCCACACT

GACCCTGTCCAAGGCCGACTACGAGAAGCACAAGGTGTACGCCTGCGAAGTGACCCATCAG

GGCCTGTCTAGCCCTGTGACCAAGTCTTTCAACCGGGGCGAGTGT

SEQ ID NO: 244
GAGGTGCAACTCCTTGAATCAGGCGGAGGACTCGTCCAACCTGGAGGGAGTCTTAGG

CTTAGCTGTGCAGCCAGTGGCTTTACTTTTAGCAGCTATGCAATGCACTGGGTCAGGCAGGC

TCCTGGTAAGGGGCTCGAATGGGTCAGCGGCATATCCGGGTCAGGTTTCTCTACATATTATG

TCGATTCTGTAAAAGGACGATTCACCATATCCAGAGACAATTCTAAAAATACCTTGTATCTC

CAGATGAACAGCCTGAGAGCAGAAGATACCGCAGTTTATTACTGTGCAAAGGATAATCTGG

TTGCCGGGACAGTTTTTGATTATTGGGGCAAGGCACCCTCGTCACAGTATCCAGTGCCTCC

ACCAAGGGCCCATCGGTCTTCCCCCTGGCACCCTCCTCCAAGAGCACCTCTGGGGGCACAGC

GGCCCTGGGCTGCCTGGTCAAGGACTACTTCCCCGAACCGGTGACGGTGTCGTGGAACTCAG

GCGCCCTGACCAGCGGCGTGCACACCTTCCCGGCTGTCCTACAGTCCTCAGGACTCTACTCC

CTCAGCAGCGTGGTGACCGTGCCCTCCAGCAGCTTGGGCACCCAGACCTACATCTGCAACGT

GAATCACAAGCCCAGCAACACCAAGGTGGACAAGAAAGTTGAGCCCAAATCTTGTGACAAA

ACTCACACATGTCCACCGTGCCCAGCACCTGAACTGCTGGGGGGACCGTCAGTCTTCCTCTT

CCCCCCAAAACCCAAGGACACCCTCATGATCTCCCGGACCCCTGAGGTCACATGCGTGGTGG

TGGACGTGAGCCACGAAGACCCTGAGGTCAAGTTCAACTGGTACGTGGACGGCGTGGAGGT

GCATAATGCCAAGACAAAGCCGCGGGAGGAGCAGTACAACAGCACGTACCGTGTGGTCAGC

-continued

```
GTCCTCACCGTCCTGCACCAGGACTGGCTGAATGGCAAGGAGTACAAGTGCAAGGTCTCCA

ACAAAGCCCTCCCAGCCCCATCGAGAAAACCATCTCCAAAGCCAAAGGGCAGCCCCGAGA

ACCACAGGTGTACACCCTGCCCCCATCCCGGGAGGAGATGACCAAGAACCAGGTCAGCCTG

ACCTGCCTGGTCAAAGGCTTCTATCCCAGCGACATCGCCGTGGAGTGGGAGAGCAATGGGC

AGCCGGAGAACAACTACAAGACCACGCCTCCCGTGCTGGACTCCGACGGCTCCTTCTTCCTC

TACAGCAAGCTCACCGTGGACAAGTCTAGATGGCAGCAGGGGAACGTCTTCTCATGCTCCGT

GATGCATGAGGCTCTGCACAACCACTACACGCAGAAGAGCCTCTCCCTGTCTCCGGGT
```

SEQ ID NO: 245
```
GATATTCAGATGACTCAATCACCTTCAACCCTTAGCGCCTCCGTTGGAGATCGCGTTA

CCATTACCTGCCGAGCCTCCCAAAGTATCAGCTCATGGTTGGCATGGTATCAACAGAAGCCT

GGAAAGGCACCCAAACTTCTGATTTACAAAGCCAGCTCCTTGGAGTCAGGAGTCCCAAGCC

GGTTCAGCGGATCTGGGTCAGGGACAGAATTTACCCTGACCATATCTTCCCTTCAGCCCGAC

GACTTCGCCACTTACTATTGTCAGCAATACAACTCCTATTCCCTGACTTTCGGCGGTGGCACA

AAGGTTGACATCAAGCGGACAGTGGCCGCTCCTTCCGTGTTCATCTTCCCACCTTCCGACGA

GCAGCTGAAGTCCGGCACAGCTTCTGTCGTGTGCCTGCTGAACAACTTCTACCCTCGGGAAG

CCAAGGTGCAGTGGAAGGTGGACAATGCCCTGCAGTCCGGCAACTCCCAAGAGTCTGTGAC

CGAGCAGGACTCCAAGGACAGCACCTACAGCCTGTCCTCCACACTGACCCTGTCCAAGGCCG

ACTACGAGAAGCACAAGGTGTACGCCTGCGAAGTGACCCATCAGGGCCTGTCTAGCCCTGT

GACCAAGTCTTTCAACCGGGGCGAGTGT
```

SEQ ID NO: 246
```
CAGGTGCAGCTTCAACAGAGCGGACCTGGTCTGGTTAAGCCTTCCCAAACCCTGAGC

CTGACTTGTGCTATTTCCGGGGATAGTGTTAGCTCCAATAGGGCAGCATGGAACTGGATCAG

ACAGTCCCCAAGCCGTGGACTTGAGTGGCTTGGACGTACTTATTACAGGAGTAAATGGTACA

ATGATTATGCCGTTTCTGTGAAGAGCCGTATTACTATAAACCCAGATACTTCTAAAAATCAA

ATTTCCCTTCAGCTCAACTCAGTTACACCAGAGGATACTGCAGTCTATTATTGCGCAAGAGTT

CGACCTGGCATTCCCTTCGATTATTGGGGGCAGGGGACACCCGTTACTGTGTCCTCAGCCTC

CACCAAGGGCCCATCGGTCTTCCCCCTGGCACCCTCCTCCAAGAGCACCTCTGGGGGCACAG

CGGCCCTGGGCTGCCTGGTCAAGGACTACTTCCCCGAACCGGTGACGGTGTCGTGGAACTCA

GGCGCCCTGACCAGCGGCGTGCACACCTTCCCGGCTGTCCTACAGTCCTCAGGACTCTACTC

CCTCAGCAGCGTGGTGACCGTGCCCTCCAGCAGCTTGGGCACCCAGACCTACATCTGCAACG

TGAATCACAAGCCCAGCAACACCAAGGTGGACAAGAAAGTTGAGCCCAAATCTTGTGACAA

AACTCACACATGTCCACCGTGCCCAGCACCTGAACTGCTGGGGGGACCGTCAGTCTTCCTCT

TCCCCCCAAAACCCAAGGACACCCTCATGATCTCCCGGACCCCTGAGGTCACATGCGTGGTG

GTGGACGTGAGCCACGAAGACCCTGAGGTCAAGTTCAACTGGTACGTGGACGGCGTGGAGG

TGCATAATGCCAAGACAAAGCCGCGGGAGGAGCAGTACAACAGCACGTACCGTGTGGTCAG

CGTCCTCACCGTCCTGCACCAGGACTGGCTGAATGGCAAGGAGTACAAGTGCAAGGTCTCCA

ACAAAGCCCTCCCAGCCCCATCGAGAAAACCATCTCCAAAGCCAAAGGGCAGCCCCGAGA

ACCACAGGTGTACACCCTGCCCCCATCCCGGGAGGAGATGACCAAGAACCAGGTCAGCCTG

ACCTGCCTGGTCAAAGGCTTCTATCCCAGCGACATCGCCGTGGAGTGGGAGAGCAATGGGC

AGCCGGAGAACAACTACAAGACCACGCCTCCCGTGCTGGACTCCGACGGCTCCTTCTTCCTC

TACAGCAAGCTCACCGTGGACAAGTCTAGATGGCAGCAGGGGAACGTCTTCTCATGCTCCGT
```

```
                                                 -continued
GATGCATGAGGCTCTGCACAACCACTACACGCAGAAGAGCCTCTCCCTGTCTCCGGGT

SEQ ID NO: 247
GATATTGTTATGACACAGTCCCCAGATTCATTGGCAGTAAGCCTCGGTGAACGGGCT

ACTATTAACTGTAAGTCTTCCCAGAGTGTATTGTTCTCTTCAAATAACAAAAACTACCTGGCA

TGGTATCAGCAAAAGCCTGGTCAACCCCCTAAACTTCTCATATACTGGGCATCCACTCGGGA

GAGCGGTGTGCCAGACCGTTTCTCAGGGAGTGTGTCAGGTACAGATTTTACACTCACAATTT

CCAGCCTCCAAGCCGAAGACGTTGCAGTATATTATTGCCAACAATATCACTCTACACCTTGG

ACATTTGGTCAAGGTACTAAAGTCGAAATCAAACGGACAGTGGCCGCTCCTTCCGTGTTCAT

CTTCCCACCTTCCGACGAGCAGCTGAAGTCCGGCACAGCTTCTGTCGTGTGCCTGCTGAACA

ACTTCTACCCTCGGGAAGCCAAGGTGCAGTGGAAGGTGGACAATGCCCTGCAGTCCGGCAA

CTCCCAAGAGTCTGTGACCGAGCAGGACTCCAAGGACAGCACCTACAGCCTGTCCTCCACAC

TGACCCTGTCCAAGGCCGACTACGAGAAGCACAAGGTGTACGCCTGCGAAGTGACCCATCA

GGGCCTGTCTAGCCCTGTGACCAAGTCTTTCAACCGGGGCGAGTGT
```

TABLE 17

Amino acid sequences of the anti-HLA-G scFvs in VH-linker-VL (HL) or in VL-linker-VH (LH) format.

| Acronym | Amino acid sequence of scFv | SEQ ID NO: |
|---|---|---|
| MHGB665-HL | QVQLWQQSGPGLVKPSQTLSLTCAISGDSVSSNSAAWNWIRQSPSRGLEWLGR TYYRSKWYNDYAVSVKSRITINPDTSKNQISLQLNSVTPEDTAVYYCAGDRRYGI VGLPFAYWGQGTLVTVSSGGSEGKSSGSGSESKSTGGSDIVMTQSPDSLAVSL GERATINCKSSQSVLHSSNNKNYLTWFQQKPGQPPKLLIYWASTRESGVPDRF SGSGSGTDFTLTISSLQAEDVAVYYCHQYYSTPPTFGQGTKVEIK | 248 |
| MHGB665-LH | DIVMTQSPDSLAVSLGERATINCKSSQSVLHSSNNKNYLTWFQQKPGQPPKLLI YWASTRESGVPDRFSGSGSGTDFTLTISSLQAEDVAVYYCHQYYSTPPTFGQGT KVEIKGGSEGKSSGSGSESKSTGGSQVQLQQSGPGLVKPSQTLSLTCAISGDSVS SNSAAWNWIRQSPSRGLEWLGRTYYRSKWYNDYAVSVKSRITINPDTSKNQIS LQLNSVTPEDTAVYYCAGDRRYGIVGLPFAYWGQGTLVTVSS | 249 |
| MHGB668-HL | QVQLQQSGPGLVKPSQTLSLTCAISGDSVSNNSAAWNWIRQSPSRGLEWLGR TYYRSKWYNDYAVSVKSRITINPDTSKNQFSLQLNSVTPEDTAVYYCARYGSGT LLFDYWGQGTLVTVSSGGSEGKSSGSGSESKSTGGSDIVMTQSPDSLAVSLGE RATINCKSSQSVLYSSKNKNYLAWYQQKPGQPPKLLIYWASTRESGVPDRFSGS GSGTDFTLTISSLQAEDVAVYYCQQYYSTFPYTFGQGTKLEIK | 250 |
| MHGB668-LH | DIVMTQSPDSLAVSLGERATINCKSSQSVLYSSKNKNYLAWYQQKPGQPPKLLI YWASTRESGVPDRFSGSGSGTDFTLTISSLQAEDVAVYYCQQYYSTFPYTFGQG TKLEIKGGSEGKSSGSGSESKSTGGSQVQLQQSGPGLVKPSQTLSLTCAISGDSV SNNSAAWNWIRQSPSRGLEWLGRTYYRSKWYNDYAVSVKSRITINPDTSKNQ FSLQLNSVTPEDTAVYYCARYGSGTLLFDYWGQGTLVTVSS | 251 |
| MHGB669-HL | QVQLQQSGPGLVRPSQTLSVTCAISGDSVSSNSASWNWIRQSPSRGLEWLGR TYYRSEWFNDYAVSVKSRVTINPDTSKNQLSLQLNSVIPEDTAVYYCAREARIG VAGKGFDYWGQGTLVTVSSGGSEGKSSGSGSESKSTGGSDIVMTQSPDSLAV SLGERATINCKSSQSVLFRSNNKNYLAWFQQKPGQPPKLLIYWASTRESGVPD RFSGSGSGTDFTLTISSLQAEDVAVYYCQQYYSTPRTFGQGTKVEIK | 252 |
| MHGB669-LH | DIVMTQSPDSLAVSLGERATINCKSSQSVLFRSNNKNYLAWFQQKPGQPPKLLI YWASTRESGVPDRFSGSGSGTDFTLTISSLQAEDVAVYYCQQYYSTPRTFGQGT KVEIKGGSEGKSSGSGSESKSTGGSQVQLQQSGPGLVRPSQTLSVTCAISGDSV SSNSASWNWIRQSPSRGLEWLGRTYYRSEWFNDYAVSVKSRVTINPDTSKNQ LSLQLNSVIPEDTAVYYCAREARIGVAGKGFDYWGQGTLVTVSS | 253 |
| MHGB672-HL | QVQLQQSGPGLVKPSQTLSLTCAISGDSVSSNRAAWNWIRQTPSRGLEWLGR TYYRSEWYNDYAVSVKSRITINPDTSKNQFSLQLNSVTPEDTAVYYCARVRAAV PFDYWGQGTLVTVSSGGSEGKSSGSGSESKSTGGSDIVMTQSPDSLAVSLGER ATINCKSSQSVLFSSNNKNYLAWYQQKPGQPPNLLIYWASTRESGVPDRFSGS VSGTDFTLTISSLQAEDVAIYYCQQYHSTPWTFGQGTKVEIK | 254 |
| MHGB672-LH | DIVMTQSPDSLAVSLGERATINCKSSQSVLFSSNNKNYLAWYQQKPGQPPNLLI YWASTRESGVPDRFSGSVSGTDFTLTISSLQAEDVAIYYCQQYHSTPWTFGQG TKVEIKGGSEGKSSGSGSESKSTGGSQVQLQQSGPGLVKPSQTLSLTCAISGDS | 255 |

TABLE 17-continued

Amino acid sequences of the anti-HLA-G scFvs in VH-linker-VL (HL) or in VL-linker-VH (LH) format.

| Acronym | Amino acid sequence of scFv | SEQ ID NO: |
|---|---|---|
| | VSSNRAAWNWIRQTPSRGLEWLGRTYYRSEWYNDYAVSVKSRITINPDTSKN QFSLQLNSVTPEDTAVYYCARVRAAVPFDYWGQGTLVTVSS | |
| MHGB687-HL | QLQLQESGPGLVKPSETLSLMCTVSGGSITSSSYYWGWIRQPPGKGLEWIGNIY YSGTTYYNPSLKSRVTISVDTSKNQFSLKLSSVTAADTAVYYCAAGARDFDSWG QGSLVTVSSGGSEGKSSGSGSESKSTGGSDIVMTQSPDSLAVSLGERATINCKSS SQSVLYSSSNKSYLAWYQQRPGQPPKLLIYWASTRESGVPDRFSGSGSGTDFTL TISSLQAEDVAVYYCQQYYSTPRMYTFGQGTKLEIK | 256 |
| MHGB687-LH | DIVMTQSPDSLAVSLGERATINCKSSQSVLYSSSNKSYLAWYQQRPGQPPKLLI YWASTRESGVPDRFSGSGSGTDFTLTISSLQAEDVAVYYCQQYYSTPRMYTFG QGTKLEIKGGSEGKSSGSGSESKSTGGSQLQLQESGPGLVKPSETLSLMCTVSG GSITSSSYYWGWIRQPPGKGLEWIGNIYYSGTTYYNPSLKSRVTISVDTSKNQFS LKLSSVTAADTAVYYCAAGARDFDSWGQGSLVTVSS | 257 |
| MHGB688-HL | EVQLLESGPGLVKPSQTLSLTCVISGDSVSSNRAAWNWIRQSPSRGLEWLGRT YYRSKWYNDYAVSVKSRITINSDTSKNQISLQLNSVTPEDTAVYYCARVRPGIPF DYWGQGTPVTVSSGGSEGKSSGSGSESKSTGGSDIVMTQSPDSLAVSLGERAT INCKSSQSVLFSSNKKNYLAWYQQKPGQPPKLLIYWASTRESGVPDRFSGSGS GTDFTLTISSLQAEDVAVYYCQQYNSTPWTFGQGTKVEIK | 258 |
| MHGB688-LH | DIVMTQSPDSLAVSLGERATINCKSSQSVLFSSNKKNYLAWYQQKPGQPPKLLI YWASTRESGVPDRFSGSGSGTDFTLTISSLQAEDVAVYYCQQYNSTPWTFGQG TKVEIKGGSEGKSSGSGSESKSTGGSEVQLLESGPGLVKPSQTLSLTCVISGDSVS SNRAAWNWIRQSPSRGLEWLGRTYYRSKWYNDYAVSVKSRITINSDTSKNQIS LQLNSVTPEDTAVYYCARVRPGIPFDYWGQGTPVTVSS | 259 |
| MHGB689-HL | QVQLQQSGPGLVKPSQTLSLTCVISGDSVSSNRAAWNWIRQSPSRGLEWLGR TYYRSKWYNDYAVSVKSRITINSDTSKNQISLQLNSVTPEDTAVYYCARVRPGIP FDYWGQGTTVTVSSGGSEGKSSGSGSESKSTGGSDIQMTQSPDSLAVSLGERA TINCESSQSVLFSSNKKNYLAWYQQKPGQPPKLLIYWASTRESGVPDRFSGSGS GTDFTLTINRLQAEDVAVYYCQQYNSTPWTFGQGTKVEIK | 260 |
| MHGB689-LH | DIQMTQSPDSLAVSLGERATINCESSQSVLFSSNKKNYLAWYQQKPGQPPKLLI YWASTRESGVPDRFSGSGSGTDFTLTINRLQAEDVAVYYCQQYNSTPWTFGQ GTKVEIKGGSEGKSSGSGSESKSTGGSQVQLQQSGPGLVKPSQTLSLTCVISGD SVSSNRAAWNWIRQSPSRGLEWLGRTYYRSKWYNDYAVSVKSRITINSDTSKN QISLQLNSVTPEDTAVYYCARVRPGIPFDYWGQGTTVTVSS | 261 |
| MHGB694-HL | EVQLLESGGGLVQPGGSLRLSCAASGFTFSSYAMHWVRQAPGKGLDWVSGIS GSGFSTYYVDSVKGRFTISRDNSKHTLYLQMNSLRAEDTAVYYCAKDNLVAGT VFDYWGQGTLVTVSSGGSEGKSSGSGSESKSTGGSDIQMTQSPSTLSASVGDR VTITCRASQSISSWLAWYQQKPGKAPKLLIYKASSLESGVPSRFSGSGSGTEFTL TISSLQPDDFATYYCQQYNSYSLTFGGGTKVDIK | 262 |
| MHGB694-LH | DIQMTQSPSTLSASVGDRVTITCRASQSISSWLAWYQQKPGKAPKLLIYKASSL ESGVPSRFSGSGSGTEFTLTISSLQPDDFATYYCQQYNSYSLTFGGGTKVDIKGG SEGKSSGSGSESKSTGGSEVQLLESGGGLVQPGGSLRLSCAASGFTFSSYAMH WVRQAPGKGLDWVSGISGSGFSTYYVDSVKGRFTISRDNSKHTLYLQMNSLR AEDTAVYYCAKDNLVAGTVFDYWGQGTLVTVSS | 263 |
| MHGB732-HL | QVQLQQSGPGLVKPSQTLSLTCAISGDSVSSNSAAWNWIRQSPSRGLEWLGR TYYRSKWYNDYAVSVKSRITINPDTSKNQISLQLNSVTPEDTAVYYCAGDRRYGI VGLPFAYWGQGTLVTVSSGGSEGKSSGSGSESKSTGGSDIVMTQSPDSLAVSL GERATINCKSSQSVLHSSNNKNYLTWFQQKPGQPPKLLIYWASTRESGVPDRF SGSGSGTDFTLTISSLQAEDVAVYYCHQYYSTPPTFGQGTKVEIK | 264 |
| MHGB732-LH | DIVMTQSPDSLAVSLGERATINCKSSQSVLHSSNNKNYLTWFQQKPGQPPKLLI YWASTRESGVPDRFSGSGSGTDFTLTISSLQAEDVAVYYCHQYYSTPPTFGQGT KVEIKGGSEGKSSGSGSESKSTGGSQVQLQQSGPGLVKPSQTLSLTCAISGDSVS SNSAAWNWIRQSPSRGLEWLGRTYYRSKWYNDYAVSVKSRITINPDTSKNQIS LQLNSVTPEDTAVYYCAGDRRYGIVGLPFAYWGQGTLVTVSS | 265 |
| MHGB737-HL | EVQLLESGGGLVQPGGSLRLSCAASGFTFSSYAMHWVRQAPGKGLEWVSGIS GSGFSTYYVDSVKGRFTISRDNSKNTLYLQMNSLRAEDTAVYYCAKDNLVAGT VFDYWGQGTLVTVSSGGSEGKSSGSGSESKSTGGSDIQMTQSPSTLSASVGDR VTITCRASQSISSWLAWYQQKPGKAPKLLIYKASSLESGVPSRFSGSGSGTEFTL TISSLQPDDFATYYCQQYNSYSLTFGGGTKVDIK | 266 |

TABLE 17-continued

Amino acid sequences of the anti-HLA-G scFvs in VH-linker-VL (HL) or in VL-linker-VH (LH) format.

| Acronym | Amino acid sequence of scFv | SEQ ID NO: |
|---|---|---|
| MHGB737-LH | DIQMTQSPSTLSASVGDRVTITCRASQSISSWLAWYQQKPGKAPKLLIYKASSL ESGVPSRFSGSGSGTEFTLTISSLQPDDFATYYCQQYNSYSLTFGGGTKVDIKGG SEGKSSGSGSESKSTGGSEVQLLESGGGLVQPGGSLRLSCAASGFTFSSYAMH WVRQAPGKGLEWVSGISGSGFSTYYVDSVKGRFTISRDNSKNTLYLQMNSLRA EDTAVYYCAKDNLVAGTVFDYWGQGTLVTVSS | 267 |
| MHGB738-HL | QVQLQQSGPGLVKPSQTLSLTCAISGDSVSSNRAAWNWIRQSPSRGLEWLGR TYYRSKWYNDYAVSVKSRITINPDTSKNQISLQLNSVTPEDTAVYYCARVRPGIP FDYWGQGTPVTVSSGGSEGKSSGSGSESKSTGGSDIVMTQSPDSLAVSLGERA TINCKSSQSVLFSSNNKNYLAWYQQKPGQPPKLLIYWASTRESGVPDRFSGSVS GTDFTLTISSLQAEDVAVYYCQQYHSTPWTFGQGTKVEIK | 268 |
| MHGB738-LH | DIVMTQSPDSLAVSLGERATINCKSSQSVLFSSNNKNYLAWYQQKPGQPPKLLI YWASTRESGVPDRFSGSVSGTDFTLTISSLQAEDVAVYYCQQYHSTPWTFGQG TKVEIKGGSEGKSSGSGSESKSTGGSQVQLQQSGPGLVKPSQTLSLTCAISGDS VSSNRAAWNWIRQSPSRGLEWLGRTYYRSKWYNDYAVSVKSRITINPDTSKN QISLQLNSVTPEDTAVYYCARVRPGIPFDYWGQGTPVTVSS | 269 |

TABLE 18

Amino acid sequences of the scFv-Fcs.

| Acronym | Amino acid sequence of scFv | SEQ ID NO: |
|---|---|---|
| MHGB665-HL-Fc | QVQLQQSGPGLVKPSQTLSLTCAISGDSVSSNSAAWNWIRQSPSRGLEWLGR TYYRSKWYNDYAVSVKSRITINPDTSKNQISLQLNSVTPEDTAVYYCAGDRRYGI VGLPFAYWGQGTLVTVSSGGSEGKSSGSGSESKSTGGSDIVMTQSPDSLAVSL GERATINCKSSQSVLHSSNNKNYLTWFQQKPGQPPKLLIYWASTRESGVPDRF SGSGSGTDFTLTISSLQAEDVAVYYCHQYYSTPPTFGQGTKVEIKEPKSSDKTHT CPPCPAPEAAGGPSVFLFPPKPKDTLMISRTPEVTCVVVSVSHEDPEVKFNWYV DGVEVHNAKTKPREEQYNSTYRVVSVLTVLHQDWLNGKEYKCKVSNKALPAPI EKTISKAKGQPREPQVYVLPPSREEMTKNQVSLLCLVKGFYPSDIAVEWESNGQ PENNYLTWPPVLDSDGSFFLYSKLTVDKSRWQQGNVFSCSVMHEALHNHYTQ KSLSLSPGK | 270 |
| MHGB665-LH-Fc | DIVMTQSPDSLAVSLGERATINCKSSQSVLHSSNNKNYLTWFQQKPGQPPKLLI YWASTRESGVPDRFSGSGSGTDFTLTISSLQAEDVAVYYCHQYYSTPPTFGQGT KVEIKGGSEGKSSGSGSESKSTGGSQVQLQQSGPGLVKPSQTLSLTCAISGDSVS SNSAAWNWIRQSPSRGLEWLGRTYYRSKWYNDYAVSVKSRITINPDTSKNQIS LQLNSVTPEDTAVYYCAGDRRYGIVGLPFAYWGQGTLVTVSSEPKSSDKTHTCP PCPAPEAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKALPAPIE KTISKAKGQPREPQVYVLPPSREEMTKNQVSLLCLVKGFYPSDIAVEWESNGQP ENNYLTWPPVLDSDGSFFLYSKLTVDKSRWQQGNVFSCSVMHEALHNHYTQK SLSLSPGK | 271 |
| MHGB668-HL-Fc | QVQLQQSGPGLVKPSQTLSLTCAISGDSVSNNSAAWNWIRQSPSRGLEWLGR TYYRSKWYNDYAVSVKSRITINPDTSKNQFSLQLNSVTPEDTAVYYCARYGSGT LLFDYWGQGTLVTVSSGGSEGKSSGSGSESKSTGGSDIVMTQSPDSLAVSLGER ATINCKSSQSVLYSSKNKNYLAWYQQKPGQPPKLLIYWASTRESGVPDRFSGS GSGTDFTLTISSLQAEDVAVYYCQQYYSTFPYTFGQGTKLEIKEPKSSDKTHTCP PCPAPEAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKALPAPIE KTISKAKGQPREPQVYVLPPSREEMTKNQVSLLCLVKGFYPSDIAVEWESNGQP ENNYLTWPPVLDSDGSFFLYSKLTVDKSRWQQGNVFSCSVMHEALHNHYTQK SLSLSPGK | 272 |
| MHGB668-LH-Fc | DIVMTQSPDSLAVSLGERATINCKSSQSVLYSSKNKNYLAWYQQKPGQPPKLLI YWASTRESGVPDRFSGSGSGTDFTLTISSLQAEDVAVYYCQQYYSTFPYTFGQG TKLEIKGGSEGKSSGSGSESKSTGGSQVQLQQSGPGLVKPSQTLSLTCAISGDSV SNNSAAWNWIRQSPSRGLEWLGRTYYRSKWYNDYAVSVKSRITINPDTSKNQ FSLQLNSVTPEDTAVYYCARYGSGTLLFDYWGQGTLVTVSSEPKSSDKTHTCPP CPAPEAAGGPSVFLFPPKPKDTLMISRTPEVTCVVVSVSHEDPEVKFNWYVDG VEVHNAKTKPREEQYNSTYRVVSVLTVLHQDWLNGKEYKCKVSNKALPAPIEK TISKAKGQPREPQVYVLPPSREEMTKNQVSLLCLVKGFYPSDIAVEWESNGQPE NNYLTWPPVLDSDGSFFLYSKLTVDKSRWQQGNVFSCSVMHEALHNHYTQKS LSLSPGK | 273 |

TABLE 18-continued

Amino acid sequences of the scFv-Fcs.

| Acronym | Amino acid sequence of scFv | SEQ ID NO: |
|---|---|---|
| MHGB669-HL-Fc | QVQLQQSGPGLVRPSQTLSVTCAISGDSVSSNSASWNWIRQSPSRGLEWLGR TYYRSEWFNDYAVSVKSRVTINPDTSKNQLSLQLNSVIPEDTAVYYCAREARIGV AGKGFDYWGQGTLVTVSSGGSEGKSSGSGSESKSTGGSDIVMTQSPDSLAVSL GERATINCKSSQSVLFRSNNKNYLAWFQQKPGQPPKLLIYWASTRESGVPDRF SGSGSGTDFTLTISSLQAEDVAVYYCQQYYSTPRTFGQGTKVEIKEPKSSDKTHT CPPCPAPEAAGGPSVFLFPPKPKDTLMISRTPEVTCVVVSVSHEDPEVKFNWYV DGVEVHNAKTKPREEQYNSTYRVVSVLTVLHQDWLNGKEYKCKVSNKALPAPI EKTISKAKGQPREPQVYVLPPSREEMTKNQVSLLCLVKGFYPSDIAVEWESNGQ PENNYLTWPPVLDSDGSFFLYSKLTVDKSRWQQGNVFSCSVMHEALHNHYTQ KSLSLSPGK | 274 |
| MHGB669-LH-Fc | DIVMTQSPDSLAVSLGERATINCKSSQSVLFRSNNKNYLAWFQQKPGQPPKLLI YWASTRESGVPDRFSGSGSGTDFTLTISSLQAEDVAVYYCQQYYSTPRTFGQGT KVEIKGGSEGKSSGSGSESKSTGGSQVQLQQSGPGLVRPSQTLSVTCAISGDSV SSNSASWNWIRQSPSRGLEWLGRTYYRSEWFNDYAVSVKSRVTINPDTSKNQ LSLQLNSVIPEDTAVYYCAREARIGVAGKGFDYWGQGTLVTVSSEPKSSDKTHT CPPCPAPEAAGGPSVFLFPPKPKDTLMISRTPEVTCVVVSVSHEDPEVKFNWYV DGVEVHNAKTKPREEQYNSTYRVVSVLTVLHQDWLNGKEYKCKVSNKALPAPI EKTISKAKGQPREPQVYVLPPSREEMTKNQVSLLCLVKGFYPSDIAVEWESNGQ PENNYLTWPPVLDSDGSFFLYSKLTVDKSRWQQGNVFSCSVMHEALHNHYTQ KSLSLSPGK | 275 |
| MHGB672-HL-Fc | QVQLQQSGPGLVKPSQTLSLTCAISGDSVSSNRAAWNWIRQTPSRGLEWLGR TYYRSEWYNDYAVSVKSRITINPDTSKNQFSLQLNSVTPEDTAVYYCARVRAAV PFDYWGQGTLVTVSSGGSEGKSSGSGSESKSTGGSDIVMTQSPDSLAVSLGER ATINCKSSQSVLFSSNNKNYLAWYQQKPGQPPNLLIYWASTRESGVPDRFSGS VSGTDFTLTISSLQAEDVAIYYCQQYHSTPWTFGQGTKVEIKEPKSSDKTHTCPP CPAPEAAGGPSVFLFPPKPKDTLMISRTPEVTCVVVSVSHEDPEVKFNWYVDG VEVHNAKTKPREEQYNSTYRVVSVLTVLHQDWLNGKEYKCKVSNKALPAPIEK TISKAKGQPREPQVYVLPPSREEMTKNQVSLLCLVKGFYPSDIAVEWESNGQPE NNYLTWPPVLDSDGSFFLYSKLTVDKSRWQQGNVFSCSVMHEALHNHYTQKS LSLSPGK | 276 |
| MHGB672-LH-Fc | DIVMTQSPDSLAVSLGERATINCKSSQSVLFSSNNKNYLAWYQQKPGQPPNLLI YWASTRESGVPDRFSGSVSGTDFTLTISSLQAEDVAIYYCQQYHSTPWTFGQG TKVEIKGGSEGKSSGSGSESKSTGGSQVQLQQSGPGLVKPSQTLSLTCAISGDSV SSNRAAWNWIRQTPSRGLEWLGRTYYRSEWYNDYAVSVKSRITINPDTSKNQ FSLQLNSVTPEDTAVYYCARVRAAVPFDYWGQGTLVTVSSEPKSSDKTHTCPP CPAPEAAGGPSVFLFPPKPKDTLMISRTPEVTCVVVSVSHEDPEVKFNWYVDG VEVHNAKTKPREEQYNSTYRVVSVLTVLHQDWLNGKEYKCKVSNKALPAPIEK TISKAKGQPREPQVYVLPPSREEMTKNQVSLLCLVKGFYPSDIAVEWESNGQPE NNYLTWPPVLDSDGSFFLYSKLTVDKSRWQQGNVFSCSVMHEALHNHYTQKS LSLSPGK | 277 |
| MHGB687-HL-Fc | QLQLQESGPGLVKPSETLSLMCTVSGGSITSSSYYWGWIRQPPGKGLEWIGNIY YSGTTYYNPSLKSRVTISVDTSKNQFSLKLSSVTAADTAVYYCAAGARDFDSWG QGSLVTVSSGGSEGKSSGSGSESKSTGGSDIVMTQSPDSLAVSLGERATINCKSS QSVLYSSSNKSYLAWYQQRPGQPPKLLIYWASTRESGVPDRFSGSGSGTDFTLT ISSLQAEDVAVYYCQQYYSTPRMYTFGQGTKLEIKEPKSSDKTHTCPPCPAPEA AGGPSVFLFPPKPKDTLMISRTPEVTCVVVSVSHEDPEVKFNWYVDGVEVHNA KTKPREEQYNSTYRVVSVLTVLHQDWLNGKEYKCKVSNKALPAPIEKTISKAKG QPREPQVYVLPPSREEMTKNQVSLLCLVKGFYPSDIAVEWESNGQPENNYLT WPPVLDSDGSFFLYSKLTVDKSRWQQGNVFSCSVMHEALHNHYTQKSLSLSP GK | 278 |
| MHGB687-LH-Fc | DIVMTQSPDSLAVSLGERATINCKSSQSVLYSSSNKSYLAWYQQRPGQPPKLLIY WASTRESGVPDRFSGSGSGTDFTLTISSLQAEDVAVYYCQQYYSTPRMYTFGQ GTKLEIKGGSEGKSSGSGSESKSTGGSQLQLQESGPGLVKPSETLSLMCTVSGGS ITSSSYYWGWIRQPPGKGLEWIGNIYYSGTTYYNPSLKSRVTISVDTSKNQFSLK LSSVTAADTAVYYCAAGARDFDSWGQGSLVTVSSEPKSSDKTHTCPPCPAPEA AGGPSVFLFPPKPKDTLMISRTPEVTCVVVSVSHEDPEVKFNWYVDGVEVHNA KTKPREEQYNSTYRVVSVLTVLHQDWLNGKEYKCKVSNKALPAPIEKTISKAKG QPREPQVYVLPPSREEMTKNQVSLLCLVKGFYPSDIAVEWESNGQPENNYLT WPPVLDSDGSFFLYSKLTVDKSRWQQGNVFSCSVMHEALHNHYTQKSLSLSP GK | 279 |
| MHGB688-HL-Fc | EVQLLESGPGLVKPSQTLSLTCVISGDSVSSNRAAWNWIRQSPSRGLEWLGRT YYRSKWYNDYAVSVKSRITINSDTSKNQISLQLNSVTPEDTAVYYCARVRPGIPF DYWGQGTPVTVSSGGSEGKSSGSGSESKSTGGSDIVMTQSPDSLAVSLGERAT INCKSSQSVLFSSNKKNYLAWYQQKPGQPPKLLIYWASTRESGVPDRFSGSGS GTDFTLTISSLQAEDVAVYYCQQYNSTPWTFGQGTKVEIKEPKSSDKTHTCPPC PAPEAAGGPSVFLFPPKPKDTLMISRTPEVTCVVVSVSHEDPEVKFNWYVDGV EVHNAKTKPREEQYNSTYRVVSVLTVLHQDWLNGKEYKCKVSNKALPAPIEKTI SKAKGQPREPQVYVLPPSREEMTKNQVSLLCLVKGFYPSDIAVEWESNGQPEN | 280 |

TABLE 18-continued

Amino acid sequences of the scFv-Fcs.

| Acronym | Amino acid sequence of scFv | SEQ ID NO: |
|---|---|---|
| | NYLTWPPVLDSDGSFFLYSKLTVDKSRWQQGNVFSCSVMHEALHNHYTQKSL<br>SLSPGK | |
| MHGB688-LH-Fc | DIVMTQSPDSLAVSLGERATINCKSSQSVLFSSNKKNYLAWYQQKPGQPPKLLI<br>YWASTRESGVPDRFSGSGSGTDFTLTISSLQAEDVAVYYCQQYNSTPWTFGQG<br>TKVEIKGGSEGKSSGSGSESKSTGGSEVQLLESGPGLVKPSQTLSLTCVISGDSVS<br>SNRAAWNWIRQSPSRGLEWLGRTYYRSKWYNDYAVSVKSRITINSDTSKNQIS<br>LQLNSVTPEDTAVYYCARVRPGIPFDYWGQGTPVTVSSEPKSSDKTHTCPPCP<br>APEAAGGPSVFLFPPKPKDTLMISRTPEVTCVVVSVSHEDPEVKFNWYVDGVE<br>VHNAKTKPREEQYNSTYRVVSVLTVLHQDWLNGKEYKCKVSNKALPAPIEKTIS<br>KAKGQPREPQVYVLPPSREEMTKNQVSLLCLVKGFYPSDIAVEWESNGQPEN<br>NYLTWPPVLDSDGSFFLYSKLTVDKSRWQQGNVFSCSVMHEALHNHYTQKSL<br>SLSPGK | 281 |
| MHGB689-HL-Fc | QVQLQQSGPGLVKPSQTLSLTCVISGDSVSSNRAAWNWIRQSPSRGLEWLGR<br>TYYRSKWYNDYAVSVKSRITINSDTSKNQISLQLNSVTPEDTAVYYCARVRPGIP<br>FDYWGQGTTVTVSSGGSEGKSSGSGSESKSTGGSDIQMTQSPDSLAVSLGERA<br>TINCESSQSVLFSSNKKNYLAWYQQKPGQPPKLLIYWASTRESGVPDRFSGSGS<br>GTDFTLTINRLQAEDVAVYYCQQYNSTPWTFGQGTKVEIKEPKSSDKTHTCPPC<br>PAPEAAGGPSVFLFPPKPKDTLMISRTPEVTCVVVSVSHEDPEVKFNWYVDGV<br>EVHNAKTKPREEQYNSTYRVVSVLTVLHQDWLNGKEYKCKVSNKALPAPIEKTI<br>SKAKGQPREPQVYVLPPSREEMTKNQVSLLCLVKGFYPSDIAVEWESNGQPEN<br>NYLTWPPVLDSDGSFFLYSKLTVDKSRWQQGNVFSCSVMHEALHNHYTQKSL<br>SLSPGK | 282 |
| MHGB689-LH-Fc | DIQMTQSPDSLAVSLGERATINCESSQSVLFSSNKKNYLAWYQQKPGQPPKLLI<br>YWASTRESGVPDRFSGSGSGTDFTLTINRLQAEDVAVYYCQQYNSTPWTFGQ<br>GTKVEIKGGSEGKSSGSGSESKSTGGSQVQLQQSGPGLVKPSQTLSLTCVISGD<br>SVSSNRAAWNWIRQSPSRGLEWLGRTYYRSKWYNDYAVSVKSRITINSDTSKN<br>QISLQLNSVTPEDTAVYYCARVRPGIPFDYWGQGTTVTVSSEPKSSDKTHTCPP<br>CPAPEAAGGPSVFLFPPKPKDTLMISRTPEVTCVVVSVSHEDPEVKFNWYVDG<br>VEVHNAKTKPREEQYNSTYRVVSVLTVLHQDWLNGKEYKCKVSNKALPAPIEK<br>TISKAKGQPREPQVYVLPPSREEMTKNQVSLLCLVKGFYPSDIAVEWESNGQPE<br>NNYLTWPPVLDSDGSFFLYSKLTVDKSRWQQGNVFSCSVMHEALHNHYTQKS<br>LSLSPGK | 283 |
| MHGB694-HL-Fc | EVQLLESGGGLVQPGGSLRLSCAASGFTFSSYAMHWVRQAPGKGLDWVSGIS<br>GSGFSTYYVDSVKGRFTISRDNSKHTLYLQMNSLRAEDTAVYYCAKDNLVAGT<br>VFDYWGQGTLVTVSSGGSEGKSSGSGSESKSTGGSDIQMTQSPSTLSASVGDR<br>VTITCRASQSISSWLAWYQQKPGKAPKLLIYKASSLESGVPSRFSGSGSGTEFTLT<br>ISSLQPDDFATYYCQQYNSYSLTFGGGTKVDIKEPKSSDKTHTCPPCPAPEAAG<br>GPSVFLFPPKPKDTLMISRTPEVTCVVVSVSHEDPEVKFNWYVDGVEVHNAKT<br>KPREEQYNSTYRVVSVLTVLHQDWLNGKEYKCKVSNKALPAPIEKTISKAKGQP<br>REPQVYVLPPSREEMTKNQVSLLCLVKGFYPSDIAVEWESNGQPENNYLTWPP<br>VLDSDGSFFLYSKLTVDKSRWQQGNVFSCSVMHEALHNHYTQKSLSLSPGK | 284 |
| MHGB694-LH-Fc | DIQMTQSPSTLSASVGDRVTITCRASQSISSWLAWYQQKPGKAPKLLIYKASSL<br>ESGVPSRFSGSGSGTEFTLTISSLQPDDFATYYCQQYNSYSLTFGGGTKVDIKGG<br>SEGKSSGSGSESKSTGGSEVQLLESGGGLVQPGGSLRLSCAASGFTFSSYAMH<br>WVRQAPGKGLDWVSGISGSGFSTYYVDSVKGRFTISRDNSKHTLYLQMNSLR<br>AEDTAVYYCAKDNLVAGTVFDYWGQGTLVTVSSEPKSSDKTHTCPPCPAPEAA<br>GGPSVFLFPPKPKDTLMISRTPEVTCVVVSVSHEDPEVKFNWYVDGVEVHNAK<br>TKPREEQYNSTYRVVSVLTVLHQDWLNGKEYKCKVSNKALPAPIEKTISKAKGQ<br>PREPQVYVLPPSREEMTKNQVSLLCLVKGFYPSDIAVEWESNGQPENNYLTWP<br>PVLDSDGSFFLYSKLTVDKSRWQQGNVFSCSVMHEALHNHYTQKSLSLSPGK | 285 |
| MHGB732-HL-Fc | QVQLQQSGPGLVKPSQTLSLTCAISGDSVSSNSAAWNWIRQSPSRGLEWLGR<br>TYYRSKWYNDYAVSVKSRITINPDTSKNQISLQLNSVTPEDTAVYYCAGDRRYGI<br>VGLPFAYWGQGTLVTVSSGGSEGKSSGSGSESKSTGGSDIVMTQSPDSLAVSL<br>GERATINCKSSQSVLHSSNNKNYLTWFQQKPGQPPKLLIYWASTRESGVPDRF<br>SGSGSGTDFTLTISSLQAEDVAVYYCHQYYSTPPTFGQGTKVEIKEPKSSDKTHT<br>CPPCPAPEAAGGPSVFLFPPKPKDTLMISRTPEVTCVVVSVSHEDPEVKFNWYV<br>DGVEVHNAKTKPREEQYNSTYRVVSVLTVLHQDWLNGKEYKCKVSNKALPAPI<br>EKTISKAKGQPREPQVYVLPPSREEMTKNQVSLLCLVKGFYPSDIAVEWESNGQ<br>PENNYLTWPPVLDSDGSFFLYSKLTVDKSRWQQGNVFSCSVMHEALHNHYTQ<br>KSLSLSPGK | 286 |
| MHGB732-LH-Fc | DIVMTQSPDSLAVSLGERATINCKSSQSVLHSSNNKNYLTWFQQKPGQPPKLLI<br>YWASTRESGVPDRFSGSGSGTDFTLTISSLQAEDVAVYYCHQYYSTPPTFGQGT<br>KVEIKGGSEGKSSGSGSESKSTGGSQVQLQQSGPGLVKPSQTLSLTCAISGDSVS<br>SNSAAWNWIRQSPSRGLEWLGRTYYRSKWYNDYAVSVKSRITINPDTSKNQIS<br>LQLNSVTPEDTAVYYCAGDRRYGIVGLPFAYWGQGTLVTVSSEPKSSDKTHTCP<br>PCPAPEAAGGPSVFLFPPKPKDTLMISRTPEVTCVVVSVSHEDPEVKFNWYVD<br>GVEVHNAKTKPREEQYNSTYRVVSVLTVLHQDWLNGKEYKCKVSNKALPAPIE | 287 |

TABLE 18-continued

Amino acid sequences of the scFv-Fcs.

| Acronym | Amino acid sequence of scFv | SEQ ID NO: |
|---|---|---|
| | KTISKAKGQPREPQVYVLPPSREEMTKNQVSLLCLVKGFYPSDIAVEWESNGQP ENNYLTWPPVLDSDGSFFLYSKLTVDKSRWQQGNVFSCSVMHEALHNHYTQK SLSLSPGK | |
| MHGB737-HL-Fc | EVQLLESGGGLVQPGGSLRLSCAASGFTFSSYAMHWVRQAPGKGLEWVSGIS GSGFSTYYVDSVKGRFTISRDNSKNTLYLQMNSLRAEDTAVYYCAKDNLVAGT VFDYWGQGTLVTVSSGGSEGKSSGSGSESKSTGGSDIQMTQSPSTLSASVGDR VTITCRASQSISSWLAWYQQKPGKAPKLLIYKASSLESGVPSRFSGSGSGTEFTLT ISSLQPDDFATYYCQQYNSYSLTFGGGTKVDIKEPKSSDKTHTCPPCPAPEAAG GPSVFLFPPKPKDTLMISRTPEVTCVVVSVSHEDPEVKFNWYVDGVEVHNAKT KPREEQYNSTYRVVSVLTVLHQDWLNGKEYKCKVSNKALPAPIEKTISKAKGQP REPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPGK | 288 |
| MHGB737-LH-Fc | DIQMTQSPSTLSASVGDRVTITCRASQSISSWLAWYQQKPGKAPKLLIYKASSL ESGVPSRFSGSGSGTEFTLTISSLQPDDFATYYCQQYNSYSLTFGGGTKVDIKGG SEGKSSGSGSESKSTGGSEVQLLESGGGLVQPGGSLRLSCAASGFTFSSYAMH WVRQAPGKGLEWVSGISGSGFSTYYVDSVKGRFTISRDNSKNTLYLQMNSLRA EDTAVYYCAKDNLVAGTVFDYWGQGTLVTVSSEPKSSDKTHTCPPCPAPEAAG GPSVFLFPPKPKDTLMISRTPEVTCVVVSVSHEDPEVKFNWYVDGVEVHNAKT KPREEQYNSTYRVVSVLTVLHQDWLNGKEYKCKVSNKALPAPIEKTISKAKGQP REPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPGK | 289 |
| MHGB738-HL-Fc | QVQLQQSGPGLVKPSQTLSLTCAISGDSVSSNRAAWNWIRQSPSRGLEWLGR TYYRSKWYNDYAVSVKSRITINPDTSKNQISLQLNSVTPEDTAVYYCARVRPGIP FDYWGQGTPVTVSSGGSEGKSSGSGSESKSTGGSDIVMTQSPDSLAVSLGERA TINCKSSQSVLFSSNNKNYLAWYQQKPGQPPKLLIYWASTRESGVPDRFSGSVS GTDFTLTISSLQAEDVAVYYCQQYHSTPWTFGQGTKVEIKEPKSSDKTHTCPPC PAPEAAGGPSVFLFPPKPKDTLMISRTPEVTCVVVSVSHEDPEVKFNWYVDGV EVHNAKTKPREEQYNSTYRVVSVLTVLHQDWLNGKEYKCKVSNKALPAPIEKTI SKAKGQPREPQVYVLPPSREEMTKNQVSLLCLVKGFYPSDIAVEWESNGQPEN NYLTWPPVLDSDGSFFLYSKLTVDKSRWQQGNVFSCSVMHEALHNHYTQKSL SLSPGK | 290 |
| MHGB738-LH-Fc | DIVMTQSPDSLAVSLGERATINCKSSQSVLFSSNNKNYLAWYQQKPGQPPKLLI YWASTRESGVPDRFSGSVSGTDFTLTISSLQAEDVAVYYCQQYHSTPWTFGQG TKVEIKGGSEGKSSGSGSESKSTGGSQVQLQQSGPGLVKPSQTLSLTCAISGDSV SSNRAAWNWIRQSPSRGLEWLGRTYYRSKWYNDYAVSVKSRITINPDTSKNQI SLQLNSVTPEDTAVYYCARVRPGIPFDYWGQGTPVTVSSEPKSSDKTHTCPPCP APEAAGGPSVFLFPPKPKDTLMISRTPEVTCVVVSVSHEDPEVKFNWYVDGVE VHNAKTKPREEQYNSTYRVVSVLTVLHQDWLNGKEYKCKVSNKALPAPIEKTIS KAKGQPREPQVYVLPPSREEMTKNQVSLLCLVKGFYPSDIAVEWESNGQPEN NYLTWPPVLDSDGSFFLYSKLTVDKSRWQQGNVFSCSVMHEALHNHYTQKSL SLSPGK | 291 |

TABLE 19 cDNA sequences of anti-HLA-G scFvs and scFv-Fcs.

| scFv or cDNA scFv-Fc | SEQ ID NO: | cDNA |
|---|---|---|
| MHGB665-HL | 292 | CAGGTGCAGCTGCAGCAGAGCGGCCCTGGACTGGTGAAGCCCAGCCAGACCC TGAGCCTGACCTGCGCTATCAGCGGCGATAGCGTGAGCTCCAACAGCGCCGC CTGGAACTGGATCAGGCAGAGCCCTAGCAGGGGCCTGGAATGGCTGGGCAGG ACCTACTACAGGAGCAAGTGGTACAACGACTACGCCGTGTCCGTGAAGAGCA GGATCACCATCAACCCCGACACCAGCAAGAACCAGATCAGCCTGCAGCTGAA CAGCGTGACCCCCGAGGACACCGCCGTGTACTACTGCGCCGGCGACAGAAGG TACGGCATCGTGGGCCTGCCTTTCGCCTACTGGGGCCAGGGAACCCTGGTGAC CGTGAGCAGCGGCGATCTGAGGGAAAGTCCAGCGGCTCCGGCAGCGAAAG CAAGTCCACCGGCGGAAGCGACATCGTGATGACCCAGAGCCCCGATAGCCTG GCTGTGAGCCTGGGCGAGAGAGCCACCATCAACTGCAAGAGCAGCCAGAGCG TGCTGCACAGCAGCAACAACAAGAACTACCTGGCTTGGTTCCAGCAGAAGCC CGGCCAGCCTCCCAAGCTGCTGATCTACTGGGCTAGCACCAGAGAGTCCGGC GTGCCTGACAGGTTCAGCGGAAGCGGCAGCGGCACCGACTTCACCCTGACCA TCAGCAGCCTGCAGGCCGAGGACGTGGCCGTGTACTACTGCCACCAGTACTA CAGCACCCCCCCTACCTTTGGCCAGGGCACCAAGGTGGAGATCAAG |

TABLE 19-continued cDNA sequences of anti-HLA-G scFvs and scFv-Fcs.

| scFv or cDNA scFv-Fc | SEQ ID NO: | cDNA |
|---|---|---|
| MHGB665-LH | 293 | GACATCGTGATGACCCAGAGCCCCGATAGCCTGGCTGTGAGCCTGGGCGAGA GAGCCACCATCAACTGCAAGAGCAGCCAGAGCGTGCTGCACAGCAGCAACAA CAAGAACTACCTGACCTGGTTCCAGCAGAAGCCCGGCCAGCCTCCCAAGCTG CTGATCTACTGGGCTAGCACCAGAGAGTCCGGCGTGCCTGACAGGTTCAGCG GAAGCGGCAGCGGCACCGACTTCACCCTGACCATCAGCAGCCTGCAGGCCGA GGACGTGGCCGTGTACTACTGCCACCAGTACTACAGCACCCCCCCTACCTTTG GCCAGGGCACCAAGGTGGAGATCAAGGGCGGATCTGAGGGAAAGTCCAGCG GCTCCGGCAGCGAAAGCAAGTCCACCGGCGGAAGCCAGGTGCAGCTGCAGCA GAGCGGCCCTGGACTGGTGAAGCCCAGCCAGACCCTGAGCCTGACCTGCGCT ATCAGCGGCGATAGCGTGAGCTCCAACAGCGCCGCCTGGAACTGGATCAGGC AGAGCCCTAGCAGGGGCCTGGAATGGCTGGGCAGGACCTACTACAGGAGCAA GTGGTACAACGACTACGCCGTGTCCGTGAAGAGCAGGATCACCATCAACCCC GACACCAGCAAGAACCAGATCAGCCTGCAGCTGAACAGCGTGACCCCCGAGG ACACCGCCGTGTACTACTGCGCCGGCGACAGAAGGTACGGCATCGTGGGCCT GCCTTTCGCCTACTGGGGCCAGGGAACCCTGGTGACCGTGAGCAGC |
| MHGB668-HL | 294 | CAGGTGCAGCTGCAGCAGAGCGGACCCGGCCTGGTGAAACCCAGCCAGACCC TGAGCCTGACCTGCGCCATCAGCGGCGACAGCGTGAGCAACAACAGCGCCGC CTGGAACTGGATCAGGCAGAGCCCCAGCAGAGGCCTGGAATGGCTGGGCAGG ACCTACTACAGGAGCAAGTGGTACAACGACTACGCCGTGAGCGTGAAGAGCA GGATCACCATCAACCCCGACACCTCCAAGAACCAGTTCAGCCTGCAGCTGAA CAGCGTGACCCCCGAGGACACCGCCGTGTACTACTGCGCCAGGTATGGCAGC GGCACCCTGCTGTTCGACTACTGGGGCCAGGGCACCCTGGTGACAGTGAGCA GCGGCGGATCTGAGGGAAAGTCCAGCGGCTCCGGCAGCGAAAGCAAGTCCAC CGGCGGAAGCGACATCGTGATGACCCAGAGCCCCGATAGCCTGGCTGTGAGC CTGGGAGAGAGGGCCACCATCAACTGCAAGAGCAGCCAGAGCGTGCTGTACA GCAGCAAGAACAAGAACTACCTGGCCTGGTACCAGCAGAAACCCGGCCAGCC CCCCAAGCTGCTGATCTACTGGGCAGCACAAGGGAAAGCGGCGTGCCCGAC AGATTCAGCGGAAGCGGCAGCGGCACCGACTTCACCCTGACCATCAGCAGCC TGCAGGCCGAGGATGTGGCCGTGTACTACTGCCAGCAGTACTACAGCACCTTC CCCTACACCTTCGGCCAGGGCACCAAGCTGGAGATCAAG |
| MHGB668-LH | 295 | GACATCGTGATGACCCAGAGCCCCGATAGCCTGGCTGTGAGCCTGGGAGAGA GGGCCACCATCAACTGCAAGAGCAGCCAGAGCGTGCTGTACAGCAGCAAGAA CAAGAACTACCTGGCCTGGTACCAGCAGAAACCCGGCCAGCCCCCCAAGCTG CTGATCTACTGGGCCAGCACAAGGGAAAGCGGCGTGCCCGACAGATTCAGCG GAAGCGGCAGCGGCACCGACTTCACCCTGACCATCAGCAGCCTGCAGGCCGA GGATGTGGCCGTGTACTACTGCCAGCAGTACTACAGCACCTTCCCCTACACCT TCGGCCAGGGCACCAAGCTGGAGATCAAGGGCGGATCTGAGGGAAAGTCCA GCGGCTCCGGCAGCGAAAGCAAGTCCACCGGCGGAAGCCAGGTGCAGCTGCA GCAGAGCGGACCCGGCCTGGTGAAACCCAGCCAGACCCTGAGCCTGACCTGC GCCATCAGCGGCGACAGCGTGAGCAACAACAGCGCCGCCTGGAACTGGATCA GGCAGAGCCCCAGCAGAGGCCTGGAATGGCTGGGCAGGACCTACTACAGGA GCAAGTGGTACAACGACTACGCCGTGAGCGTGAAGAGCAGGATCACCATCAA CCCCGACACCTCCAAGAACCAGTTCAGCCTGCAGCTGAACAGCGTGACCCCC GAGGACACCGCCGTGTACTACTGCGCCAGGTATGGCAGCGGCACCCTGCTGT TCGACTACTGGGGCCAGGGCACCCTGGTGACAGTGAGCAGC |
| MHGB669-HL | 296 | CAGGTGCAGCTGCAGCAGAGCGGACCCGGACTGGTGAGACCCAGCCAGACCC TGAGCGTGACCTGCGCCATCAGCGGCGACAGCGTGAGCAGCAACAGCGCCAG CTGGAACTGGATCAGGCAGAGCCCCAGCAGAGGCCTGGAGTGGCTGGGAAGG GACATACTACAGGAGCGAGTGGTTCAACGACTACGCCGTGAGCGTGAAGAGC AGGGTGACCATCAACCCCGACACCAGCAAGAACCAGCTGAGCCTGCAGCTGA ACAGCGTGATCCCCGAGGACACCGCCGTGTACTACTGCGCCAGAGAGGCCAG AATCGGCGTGGCCGGCAAAGGCTTCGACTACTGGGGCCAGGGCACCCTGGTG ACAGTGTCCAGCGGCGGATCTGAGGGAAAGTCCAGCGGCTCCGGCAGCGAAA GCAAGTCCACCGGCGGAAGCGACATCGTGATGACCCAGAGCCCTGACTCCCT GGCTGTGAGCCTGGGCGAGAGAGCCACCATCAACTGCAAGAGCAGCCAGAGC GTGCTGTTCAGGAGCAACAACAAGAACTACCTGGCCTGGTTCCAGCAGAAGC CCGGCCAGCCTCCCAAGCTGCTGATCTACTGGGCCAGCACCAGAGAGAGCGG CGTGCCCGATAGATTTAGCGGCAGCGGCAGCGGCACCGACTTTACCCTGACC ATCAGCTCCCTGCAGGCCGAGGATGTGGCCGTGTACTACTGCCAGCAGTACTA CAGCACCCCCAGAACCTTCGGCCAGGGCACCAAGGTGGAGATCAAG |
| MHGB669-LH | 297 | GACATCGTGATGACCCAGAGCCCTGACTCCCTGGCTGTGAGCCTGGGCGAGA GAGCCACCATCAACTGCAAGAGCAGCCAGAGCGTGCTGTTCAGGAGCAACAA CAAGAACTACCTGGCCTGGTTCCAGCAGAAGCCCGGCCAGCCTCCCAAGCTG CTGATCTACTGGGCCAGCACCAGAGAGAGCGGCGTGCCCGATAGATTTAGCG GCAGCGGCAGCGGCACCGACTTTACCCTGACCATCAGCAGCCTGCAGGCCGA GGATGTGGCCGTGTACTACTGCCAGCAGTACTACAGCACCCCCAGAACCTTCG GCCAGGGCACCAAGGTGGAGATCAAGGGCGGATCTGAGGGAAAGTCCAGCG GCTCCGGCAGCGAAAGCAAGTCCACCGGCGGAAGCCAGGTGCAGCTGCAGCA GAGCGGACCCGGACTGGTGAGACCCAGCCAGACCCTGAGCGTGACCTGCGCC ATCAGCGGCGACAGCGTGAGCAGCAACAGCGCCAGCTGGAACTGGATCAGGC |

TABLE 19-continued cDNA sequences of anti-HLA-G scFvs and scFv-Fcs.

| scFv or cDNA scFv-Fc | SEQ ID NO: | cDNA |
|---|---|---|
| | | AGAGCCCCAGCAGAGGCCTGGAGTGGCTGGGAAGGACATACTACAGGAGCG AGTGGTTCAACGACTACGCCGTGAGCGTGAAGAGCAGGGTGACCATCAACCC CGACACCAGCAAGAACCAGCTGAGCCTGCAGCTGAACAGCGTGATCCCCGAG GACACCGCCGTGTACTACTGCGCCAGAGAGGCCAGAATCGGCGTGGCCGGCA AAGGCTTCGACTACTGGGGCCAGGGCACCCTGGTGACAGTGTCCAGC |
| MHGB672-HL | 298 | CAGGTGCAGCTGCAGCAGAGCGGACCTGGCCTGGTGAAGCCCAGCCAGACCC TGAGCCTGACATGCGCCATCAGCGGCGACAGCGTGAGCAGCAATAGGGCCGC CTGGAACTGGATCAGGCAGACCCCTAGCAGGGGCCTGGAATGGCTGGGCAGG ACATACTACAGGAGCGAGTGGTACAACGACTACGCCGTGTCCGTGAAGAGCA GGATCACCATCAACCCCGACACCAGCAAGAACCAGTTCAGCCTGCAGCTGAA CAGCGTGACCCCCGAGGACACCGCCGTGTACTACTGCGCCAGAGTGAGAGCC GCCGTGCCTTTCGACTACTGGGGCCAGGGCACCCTGGTGACAGTGAGCAGCG GCGGATCTGAGGGAAAGTCCAGCGGCTCCGGCAGCAAAGCAAGTCCACCGG CGGAAGCGACATCGTGATGACCCAGAGCCCCGATAGCCTGGCTGTGAGCCTG GGCGAGAGGGCCACCATCAACTGCAAGAGCAGCCAGAGCGTGCTGTTTTCCA GCAACAACAAGAACTACCTGGCCTGGTACCAGCAGAAACCCGGCCAGCCCCC CAACCTGCTGATCTACTGGGCCAGCACCAGAGAAAGCGGCGTGCCCGACAGG TTTAGCGGCAGCGTGAGCGGCACCGACTTCACCCTGACCATCAGCAGCCTGC AGGCCGAGGACGTGGCCATCTACTACTGCCAGCAGTACCACAGCACCCCCTG GACATTCGGCCAGGGCACCAAGGTGGAGATCAAG |
| MHGB672-LH | 299 | GACATCGTGATGACCCAGAGCCCCGATAGCCTGGCTGTGAGCCTGGGCGAGA GGGCCACCATCAACTGCAAGAGCAGCCAGAGCGTGCTGTTTTCCAGCAACAA CAAGAACTACCTGGCCTGGTACCAGCAGAAACCCGGCCAGCCCCCCAACCTG CTGATCTACTGGGCCAGCACCAGAGAAAGCGGCGTGCCCGACAGGTTTAGCG GCAGCGTGAGCGGCACCGACTTCACCCTGACCATCAGCAGCCTGCAGGCCGA GGACGTGGCCATCTACTACTGCCAGCAGTACCACAGCACCCCCTGGACATTCG GCCAGGGCACCAAGGTGGAGATCAAGGGCGGATCTGAGGGAAAGTCCAGCG GCTCCGGCAGCAAAGCAAGTCCACCGGCGGAAGCCAGGTGCAGCTGCAGCA GAGCGGACCTGGCCTGGTGAAGCCCAGCCAGACCCTGAGCCTGACATGCGCC ATCAGCGGCGACAGCGTGAGCAGCAATAGGGCCGCCTGGAACTGGATCAGGC AGACCCCTAGCAGGGGCCTGGAATGGCTGGGCAGGACATACTACAGGAGCGA GTGGTACAACGACTACGCCGTGTCCGTGAAGAGCAGGATCACCATCAACCCC GACACCAGCAAGAACCAGTTCAGCCTGCAGCTGAACAGCGTGACCCCCGAGG ACACCGCCGTGTACTACTGCGCCAGAGTGAGAGCCGCCGTGCCTTTCGACTAC TGGGGCCAGGGCACCCTGGTGACAGTGAGCAGC |
| MHGB687-HL | 300 | CAGCTGCAGCTGCAGGAGAGCGGCCCTGGACTGGTGAAGCCCAGCGAGACCC TGAGCCTGATGTGCACCGTGAGCGGCGGCAGCATCACCAGCAGCTACTA CTGGGGATGGATCAGACAGCCCCCTGGCAAGGGCCTGGAGTGGATCGGCAAC ATCTACTACAGCGGCACCACCTACTACAACCCCAGCCTGAAGAGCAGGGTGA CCATCAGCGTGGACACCAGCAAGAACCAGTTCAGCCTGAAGCTGAGCAGCGT GACAGCTGCCGACACCGCCGTGTACTACTGTGCCGCCGGAGCCAGAGACTTC GACAGCTGGGGACAGGGCAGCCTGGTGACCGTGTCCAGCGGCGGATCTGAGG GAAAGTCCAGCGGCTCCGGCAGCAAAGCAAGTCCACCGGCGGAAGCGACA TCGTGATGACCCAGAGCCCTGATAGCCTGGCCGTGAGCCTGGGAGAGAGAGC CACCATCAACTGCAAGTCCTCCCAGAGCGTGCTGTACAGCTCCAGCAACAAG AGCTACCTGGCCTGGTACCAGCAGAGGCCCGGACAGCCTCCCAAGCTGCTGA TCTACTGGGCCAGCACCAGAGAGAGCGGCGTGCCTGACAGGTTTAGCGGCTC CGGCTCCGGCACCGACTTTACCCTGACCATCAGCAGCCTGCAGGCCGAGGAT GTGGCCGTGTACTACTGCCAGCAGTACTACAGCACCCCCAGGATGTACACCTT CGGCCAGGGCACCAAGCTGGAGATCAAG |
| MHGB687-LH | 301 | GACATCGTGATGACCCAGAGCCCTGATAGCCTGGCCGTGAGCCTGGGAGAGA GAGCCACCATCAACTGCAAGTCCTCCCAGAGCGTGCTGTACAGCTCCAGCAA CAAGAGCTACCTGGCCTGGTACCAGCAGAGGCCCGGACAGCCTCCCAAGCTG CTGATCTACTGGGCCAGCACCAGAGAGAGCGGCGTGCCTGACAGGTTTAGCG GCTCCGGCTCCGGCACCGACTTTACCCTGACCATCAGCAGCCTGCAGGCCGAG GATGTGGCCGTGTACTACTGCCAGCAGTACTACAGCACCCCCAGGATGTACA CCTTCGGCCAGGGCACCAAGCTGGAGATCAAGGGCGGATCTGAGGGAAAGTC CAGCGGCTCCGGCAGCAAAGCAAGTCCACCGGCGGAAGCCAGCTGCAGCTG CAGGAGAGCGGCCCTGGACTGGTGAAGCCCAGCGAGACCCTGAGCCTGATGT GCACCGTGAGCGGCGGCAGCATCACCAGCAGCAGCTACTACTGGGGATGGAT CAGACAGCCCCCTGGCAAGGGCCTGGAGTGGATCGGCAACATCTACTACAGC GGCACCACCTACTACAACCCCAGCCTGAAGAGCAGGGTGACCATCAGCGTGG ACACCAGCAAGAACCAGTTCAGCCTGAAGCTGAGCAGCGTGACAGCTGCCGA CACCGCCGTGTACTACTGTGCCGCCGGAGCCAGAGACTTCGACAGCTGGGGA CAGGGCAGCCTGGTGACCGTGTCCAGC |
| MHGB688-HL | 302 | GAGGTGCAGCTGTTGGAGTCAGGTCCAGGACTGGTGAAGCCCTCGCAGACCC TCTCACTCACCTGTGTCATCTCCGGGGACAGTGTCTCTAGCAACAGAGCTGCT TGGAACTGGATCAGGCAGTCCCCATCGAGAGGCCTTGAGTGGCTGGGAAGGA CATACTACAGGTCCAAGTGGTATAATGATTATGCAGTATCTGTGAAAAGTCGA |

TABLE 19-continued cDNA sequences of anti-HLA-G scFvs and scFv-Fcs.

| scFv or cDNA scFv-Fc | SEQ ID NO: | cDNA |
|---|---|---|
| | | ATAACCATCAATTCAGACACATCCAAGAACCAGATCTCCCTGCAGTTGAACTC<br>TGTGACTCCCGAGGACACGGCTGTGTATTACTGTGCAAGAGTGAGACCGGGG<br>ATCCCATTTGACTACTGGGGCCAGGGAACCCCGGTCACCGTCTCCTCAGGCGG<br>ATCTGAGGGAAAGTCCAGCGGCTCCGGCAGCGAAAGCAAGTCCACCGGCGGA<br>AGCGACATCGTGATGACCCAGTCTCCAGACTCCCTGGCTGTGTCTCTGGGCGA<br>GAGGGCCACCATCAACTGCAAGTCCAGCCAGAGTGTTTATTCAGCTCCAACA<br>AAAAGAACTACTTAGCTTGGTACCAGCAGAAACCAGGACAGCCCCCTAAGCT<br>GCTCATTTACTGGGCATCTACCCGGGAATCCGGGGTCCCTGACCGATTCAGTG<br>GCAGCGGGTCTGGGACAGATTTCACTCTCACCATCAGCAGCCTGCAGGCTGA<br>AGATGTGGCAGTTTATTACTGTCAGCAATATAATAGTACTCCGTGGACGTTCG<br>GCCAAGGGACCAAGGTGGAGATCAAA |
| MHGB688-LH | 303 | GACATCGTGATGACCCAGTCTCCAGACTCCCTGGCTGTGTCTCTGGGCGAGAG<br>GGCCACCATCAACTGCAAGTCCAGCCAGAGTGTTTTATTCAGCTCCAACAAAA<br>AGAACTACTTAGCTTGGTACCAGCAGAAACCAGGACAGCCCCCTAAGCTGCT<br>CATTTACTGGGCATCTACCCGGGAATCCGGGGTCCCTGACCGATTCAGTGGCA<br>GCGGGTCTGGGACAGATTTCACTCTCACCATCAGCAGCCTGCAGGCTGAAGA<br>TGTGGCAGTTTATTACTGTCAGCAATATAATAGTACTCCGTGGACGTTCGGCC<br>AAGGGACCAAGGTGGAGATCAAAGGCGGATCTGAGGGAAAGTCCAGCGGCT<br>CCGGCAGCGAAAGCAAGTCCACCGGCGGAAGCGAGGTGCAGCTGTTGGAGTC<br>AGGTCCAGGACTGGTGAAGCCCTCGCAGACCCTCTCACTCACCTGTGTCATCT<br>CCGGGGACAGTGTCTCTAGCAACAGAGCTGCTTGGAACTGGATCAGGCAGTC<br>CCCATCGAGAGGCCTTGAGTGGCTGGGAAGGACATACTACAGGTCCAAGTGG<br>TATAATGATTATGCAGTATCTGTGAAAAGTCGAATAACCATCAATTCAGACAC<br>ATCCAAGAACCAGATCTCCCTGCAGTTGAACTCTGTGACTCCCGAGGACACG<br>GCTGTGTATTACTGTGCAAGAGTGAGACCGGGGATCCCATTTGACTACTGGGG<br>CCAGGGAACCCCGGTCACCGTCTCCTCA |
| MHGB689-HL | 304 | CAGGTACAGCTGCAGCAGTCAGGTCCAGGACTGGTGAAGCCCTCGCAGACCC<br>TCTCACTCACCTGTGTCATCTCCGGGGACAGTGTCTCTAGCAACAGAGCTGCC<br>TGGAACTGGATCAGGCAGTCCCCATCGAGAGGCCTTGAGTGGCTGGGAAGGA<br>CATACTACAGGTCCAAGTGGTATAATGATTATGCAGTTTCTGTGAAAAGTCGA<br>ATAACCATCAATTCAGACACATCCAAGAACCAGATCTCCCTGCAGTTGAACTC<br>TGTGACTCCCGAGGACACGGCTGTGTATTACTGTGCAAGAGTGAGACCGGGG<br>ATCCCTTTTGACTACTGGGGCCAGGGAACCACGGTCACCGTCTCCTCAGGCGG<br>ATCTGAGGGAAAGTCCAGCGGCTCCGGCAGCGAAAGCAAGTCCACCGGCGGA<br>AGCGACATCCAGATGACCCAGTCTCCAGACTCCCTGGCTGTGTCTCTGGGCGA<br>GAGGGCCACCATCAACTGCGAGTCCAGCCAGAGTGTTTATTCAGCTCCAACA<br>AAAAGAACTACTTAGCTTGGTACCAGCAGAAACCAGGACAGCCCCCTAAGCT<br>GCTCATTTACTGGGCATCTACCCGGGAATCCGGGGTCCCTGACCGATTCAGTG<br>GCAGCGGGTCTGGGACAGATTTCACTCTCACCATCAACCGCCTGCAGGCTGA<br>AGATGTGGCAGTTTATTACTGTCAGCAATATAATAGTACTCCGTGGACGTTCG<br>GCCAAGGGACCAAGGTGGAGATCAAA |
| MHGB689-LH | 305 | GACATCCAGATGACCCAGTCTCCAGACTCCCTGGCTGTGTCTCTGGGCGAGAG<br>GGCCACCATCAACTGCGAGTCCAGCCAGAGTGTTTTATTCAGCTCCAACAAAA<br>AGAACTACTTAGCTTGGTACCAGCAGAAACCAGGACAGCCCCCTAAGCTGCT<br>CATTTACTGGGCATCTACCCGGGAATCCGGGGTCCCTGACCGATTCAGTGGCA<br>GCGGGTCTGGGACAGATTTCACTCTCACCATCAACCGCCTGCAGGCTGAAGAT<br>GTGGCAGTTTATTACTGTCAGCAATATAATAGTACTCCGTGGACGTTCGGCCA<br>AGGGACCAAGGTGGAGATCAAAGGCGGATCTGAGGGAAAGTCCAGCGGCTC<br>CGGCAGCGAAAGCAAGTCCACCGGCGGAAGCCAGGTACAGCTGCAGCAGTC<br>AGGTCCAGGACTGGTGAAGCCCTCGCAGACCCTCTCACTCACCTGTGTCATCT<br>CCGGGGACAGTGTCTCTAGCAACAGAGCTGCCTGGAACTGGATCAGGCAGTC<br>CCCATCGAGAGGCCTTGAGTGGCTGGGAAGGACATACTACAGGTCCAAGTGG<br>TATAATGATTATGCAGTTTCTGTGAAAAGTCGAATAACCATCAATTCAGACAC<br>ATCCAAGAACCAGATCTCCCTGCAGTTGAACTCTGTGACTCCCGAGGACACG<br>GCTGTGTATTACTGTGCAAGAGTGAGACCGGGGATCCCTTTTGACTACTGGGG<br>CCAGGGAACCACGGTCACCGTCTCCTCA |
| MHGB694-HL | 306 | GAGGTGCAGCTGTTGGAGTCTGGGGGAGGCTTGGTACAGCCTGGGGGGTCCC<br>TGAGACTCTCCTGTGCAGCCTCTGGATTCACCTTTAGCAGCTATGCCATGCAC<br>TGGGTCCGCCAGGCCCCAGGGAAGGGGCTGGACTGGGTCTCAGGTATTAGTG<br>GTAGTGGCTTTAGCACATACTATGTAGACTCCGTGAAGGGCCGGTTCACCATC<br>TCCAGAGACAATTCCAAGCACACGCTGTATCTGCAAATGAACAGCCTGAGAG<br>CCGAGGACACGGCCGTATATTACTGTGCGAAAGATAATTTAGTGGCTGGTAC<br>CGTCTTTGACTACTGGGGCCAGGGAACCCTGGTCACCGTCTCCTCAGGCGGAT<br>CTGAGGGAAAGTCCAGCGGCTCCGGCAGCGAAAGCAAGTCCACCGGCGGAA<br>GCGACATCCAGATGACCCAGTCTCCTTCCACCCTGTCTGCATCTGTAGGAGAC<br>AGAGTCACCATCACTTGCCGGGCCAGTCAGAGTATTAGTAGCTGGTTGGCCTG<br>GTATCAGCAGAAACCAGGGAAAGCCCCTAAGCTCCTGATCTATAAGGCGTCT |

TABLE 19-continued cDNA sequences of anti-HLA-G scFvs and scFv-Fcs.

| scFv or cDNA scFv-Fc | SEQ ID NO: | cDNA |
|---|---|---|
| | | AGTTTAGAAAGTGGGGTCCCATCAAGGTTCAGCGGCAGTGGATCTGGGACAG<br>AATTCACTCTCACCATCAGCAGCCTGCAGCCTGATGATTTTGCAACTTATTAC<br>TGCCAACAGTATAATAGTTATTCGCTCACTTTCGGCGGAGGGACCAAGGTGG<br>ATATCAAA |
| MHGB694-LH | 307 | GACATCCAGATGACCCAGTCTCCTTCCACCCTGTCTGCATCTGTAGGAGACAG<br>AGTCACCATCACTTGCCGGGCCAGTCAGAGTATTAGTAGCTGGTTGGCCTGGT<br>ATCAGCAGAAACCAGGGAAAGCCCCTAAGCTCCTGATCTATAAGGCGTCTAG<br>TTTAGAAAGTGGGGTCCCATCAAGGTTCAGCGGCAGTGGATCTGGGACAGAA<br>TTCACTCTCACCATCAGCAGCCTGCAGCCTGATGATTTTGCAACTTATTACTGC<br>CAACAGTATAATAGTTATTCGCTCACTTTCGGCGGAGGGACCAAGGTGGATAT<br>CAAAGGCGGATCTGAGGGAAAGTCCAGCGGCTCCGGCAGCGAAAGCAAGTC<br>CACCGGCGGAAGCGAGGTGCAGCTGTTGGAGTCTGGGGGAGGCTTGGTACAG<br>CCTGGGGGGTCCCTGAGACTCTCCTGTGCAGCCTCTGGATTCACCTTTAGCAG<br>CTATGCCATGCACTGGGTCCGCCAGGCCCCAGGGAAGGGGCTGGACTGGGTC<br>TCAGGTATTAGTGGTAGTGGCTTTAGCACATACTATGTAGACTCCGTGAAGGG<br>CCGGTTCACCATCTCCAGAGACAATTCCAAGCACACGCTGTATCTGCAAATGA<br>ACAGCCTGAGAGCCGAGGACACGGCCGTATATTACTGTGCGAAAGATAATTT<br>AGTGGCTGGTACCGTCTTTGACTACTGGGGCCAGGGAACCCTGGTCACCGTCT<br>CCTCA |
| MHGB732-HL | 308 | CAAGTACAACTGCAACAAAGTGGTCCTGGGCTCGTGAAGCCTTCCCAGACTCT<br>CAGCCTCACATGCGCTATAAGTGGGGATTCTGTTTCCTCAAATTCAGCAGCCT<br>GGAATTGGATACGACAGTCTCCATCCCGTGGCCTTGAGTGGCTTGGTAGAACT<br>TATTACCGATCCAAGTGGTACAATGATTACGCCGTTTCAGTGAAGTCCCGCAT<br>TACTATTAATCCCGACACATCTAAGAATCAAATTTCATTGCAACTGAATAGCG<br>TAACACCCGAAGATACAGCAGTTTATTATTGTGCAGGTGATCGACGCTACGGC<br>ATAGTGGGACTTCCTTTCGCCTATTGGGGCCAAGGGACACTGGTCACTGTGTC<br>ATCCGGCGGATCTGAGGGAAAGTCCAGCGGCTCCGGCAGCGAAAGCAAGTCC<br>ACCGGCGGAAGCGACATCGTAATGACACAGTCACCAGATTCATTGGCAGTTA<br>GTCTGGGTGAAAGGGCAACAATCAACTGCAAGTCTTCTCAGAGTGTACTGCA<br>TAGTTCTAACAATAAGAACTACCTTACCTGGTTTCAACAGAAACCAGGTCAGC<br>CCCCCAAGTTGCTGATTTACTGGGCAAGCACCCGCGAATCCGGCGTTCCCGAT<br>CGATTTTCAGGTTCCGGGAGTGGGACCGACTTTACCTTGACCATCTCTTCCTTG<br>CAGGCCGAAGATGTAGCCGTCTATTACTGCCATCAGTATTACTCTACTCCCCC<br>CACATTCGGTCAAGGTACAAAAGTTGAGATAAAA |
| MHGB732-LH | 309 | GACATCGTAATGACACAGTCACCAGATTCATTGGCAGTTAGTCTGGGTGAAA<br>GGGCAACAATCAACTGCAAGTCTTCTCAGAGTGTACTGCATAGTTCTAACAAT<br>AAGAACTACCTTACCTGGTTTCAACAGAAACCAGGTCAGCCCCCCAAGTTGCT<br>GATTTACTGGGCAAGCACCCGCGAATCCGGCGTTCCCGATCGATTTTCAGGTT<br>CCGGGAGTGGGACCGACTTTACCTTGACCATCTCTTCCTTGCAGGCCGAAGAT<br>GTAGCCGTCTATTACTGCCATCAGTATTACTCTACTCCCCCACATTCGGTCAA<br>GGTACAAAAGTTGAGATAAAAGGCGGATCTGAGGGAAAGTCCAGCGGCTCCG<br>GCAGCGAAAGCAAGTCCACCGGCGGAAGCCAAGTACAACTGCAACAAAGTG<br>GTCCTGGGCTCGTGAAGCCTTCCCAGACTCTCAGCCTCACATGCGCTATAAGT<br>GGGGATTCTGTTTCCTCAAATTCAGCAGCCTGGAATTGGATACGACAGTCTCC<br>ATCCCGTGGCCTTGAGTGGCTTGGTAGAACTTATTACCGATCCAAGTGGTACA<br>ATGATTACGCCGTTTCAGTGAAGTCCCGCATTACTATTAATCCCGACACATCT<br>AAGAATCAAATTTCATTGCAACTGAATAGCGTAACACCCGAAGATACAGCAG<br>TTTATTATTGTGCAGGTGATCGACGCTACGGCATAGTGGGACTTCCTTTCGCC<br>TATTGGGGCCAAGGGACACTGGTCACTGTGTCATCC |
| MHGB737-HL | 310 | GAGGTGCAACTCCTTGAATCAGGCGGAGGACTCGTCCAACCTGGAGGGAGTC<br>TTAGGCTTAGCTGTGCAGCCAGTGGCTTTACTTTTAGCAGCTATGCAATGCAC<br>TGGGTCAGGCAGGCTCCTGGTAAGGGGCTCGAATGGGTCAGCGGCATATCCG<br>GGTCAGGTTTCTCTACATATTATGTCGATTCTGTAAAAGGACGATTCACCATA<br>TCCAGAGACAATTCTAAAAATACCTTGTATCTCCAGATGAACAGCCTGAGAG<br>CAGAAGATACCGCAGTTTATTACTGTGCAAAGGATAATCTGGTTGCCGGGAC<br>AGTTTTTGATTATTGGGGCAAGGCACCCTCGTCACAGTATCCAGTGGCGGAT<br>CTGAGGGAAAGTCCAGCGGCTCCGGCAGCGAAAGCAAGTCCACCGGCGGAA<br>GCGATATTCAGATGACTCAATCACCTTCAACCCTTAGCGCCTCCGTTGGAGAT<br>CGCGTTACCATTACCTGCCGAGCCTCCCAAAGTATCAGCTCATGGTTGGCATG<br>GTATCAACAGAAGCCTGGAAAGGCACCCAAACTTCTGATTTACAAAGCCAGC<br>TCCTTGGAGTCAGGAGTCCCAAGCCGGTTCAGCGGATCTGGGTCAGGGACAG<br>AATTTACCCTGACCATATCTTCCCTTCAGCCCGACGACTTCGCCACTTACTATT<br>GTCAGCAATACAACTCCTATTCCCTGACTTTCGGCGGTGGCACAAAGGTTGAC<br>ATCAAG |
| MHGB737-LH | 311 | GATATTCAGATGACTCAATCACCTTCAACCCTTAGCGCCTCCGTTGGAGATCG<br>CGTTACCATTACCTGCCGAGCCTCCCAAAGTATCAGCTCATGGTTGGCATGGT<br>ATCAACAGAAGCCTGGAAAGGCACCCAAACTTCTGATTTACAAAGCCAGCTC<br>CTTGGAGTCAGGAGTCCCAAGCCGGTTCAGCGGATCTGGGTCAGGGACAGAA<br>TTTACCCTGACCATATCTTCCCTTCAGCCCGACGACTTCGCCACTTACTATTGT |

TABLE 19-continued cDNA sequences of anti-HLA-G scFvs and scFv-Fcs.

| scFv or cDNA scFv-Fc | SEQ ID NO: | cDNA |
|---|---|---|
| | | CAGCAATACAACTCCTATTCCCTGACTTTCGGCGGTGGCACAAAGGTTGACAT<br>CAAGGGCGGATCTGAGGGAAAGTCCAGCGGCTCCGGCAGCGAAAGCAAGTC<br>CACCGGCGGAAGCGAGGTGCAACTCCTTGAATCAGGCGGAGGACTCGTCCAA<br>CCTGGAGGGAGTCTTAGGCTTAGCTGTGCAGCCAGTGCTTTACTTTTAGCAG<br>CTATGCAATGCACTGGGTCAGGCAGGCTCCTGGTAAGGGGCTCGAATGGGTC<br>AGCGGCATATCCGGGTCAGGTTTCTCTACATATTATGTCGATTCTGTAAAAGG<br>ACGATTCACCATATCCAGAGACAATTCTAAAAATACCTTGTATCTCCAGATGA<br>ACAGCCTGAGAGCAGAAGATACCGCAGTTTATTACTGTGCAAAGGATAATCT<br>GGTTGCCGGGACAGTTTTTGATTATTGGGGCAAGGCACCCTCGTCACAGTAT<br>CCAGT |
| MHGB738-HL | 312 | CAGGTGCAGCTTCAACAGAGCGGACCTGGTCTGGTTAAGCCTTCCCAAACCCT<br>GAGCCTGACTTGTGCTATTTCCGGGGATAGTGTTAGCTCCAATAGGGCAGCAT<br>GGAACTGGATCAGACAGTCCCCAAGCCGTGGACTTGAGTGGCTTGGACGTAC<br>TTATTACAGGAGTAAATGGTACAATGATTATGCCGTTTCTGTGAAGAGCCGTA<br>TTACTATAAACCCAGATACTTCTAAAAATCAAATTTCCCTTCAGCTCAACTCA<br>GTTACACCAGAGGATACTGCAGTCTATTATTGCGCAAGAGTTCGACCTGGCAT<br>TCCCTTCGATTATTGGGGCAGGGGACACCCGTTACTGTGTCCTCAGGCGGAT<br>CTGAGGGAAAGTCCAGCGGCTCCGGCAGCGAAAGCAAGTCCACCGGCGGAA<br>GCGATATTGTTATGACACAGTCCCCAGATTCATTGGCAGTAAGCCTCGGTGAA<br>CGGGCTACTATTAACTGTAAGTCTTCCCAGAGTGTATTGTTCTCTTCAAATAA<br>CAAAAACTACCTGGCATGGTATCAGCAAAAGCCTGGTCAACCCCCTAAACTT<br>CTCATATACTGGGCATCCACTCGGGAGAGCGGTGTGCCAGACCGTTTCTCAGG<br>GAGTGTGTCAGGTACAGATTTTACACTCACAATTTCCAGCCTCCAAGCCGAAG<br>ACGTTGCAGTATATTATTGCCAACAATATCACTCTACACCTTGGACATTTGGT<br>CAAGGTACTAAAGTCGAAATCAAA |
| MHGB738-LH | 313 | GATATTGTTATGACACAGTCCCCAGATTCATTGGCAGTAAGCCTCGGTGAACG<br>GGCTACTATTAACTGTAAGTCTTCCCAGAGTGTATTGTTCTCTTCAAATAACA<br>AAAACTACCTGGCATGGTATCAGCAAAAGCCTGGTCAACCCCCTAAACTTCTC<br>ATATACTGGGCATCCACTCGGGAGAGCGGTGTGCCAGACCGTTTCTCAGGGA<br>GTGTGTCAGGTACAGATTTTACACTCACAATTTCCAGCCTCCAAGCCGAAGAC<br>GTTGCAGTATATTATTGCCAACAATATCACTCTACACCTTGGACATTTGGTCA<br>AGGTACTAAAGTCGAAATCAAAGGCGGATCTGAGGGAAAGTCCAGCGGCTCC<br>GGCAGCGAAAGCAAGTCCACCGGCGGAAGCCAGGTGCAGCTTCAACAGAGC<br>GGACCTGGTCTGGTTAAGCCTTCCCAAACCCTGAGCCTGACTTGTGCTATTTC<br>CGGGGATAGTGTTAGCTCCAATAGGGCAGCATGGAACTGGATCAGACAGTCC<br>CCAAGCCGTGGACTTGAGTGGCTTGGACGTACTTATTACAGGAGTAAATGGT<br>ACAATGATTATGCCGTTTCTGTGAAGAGCCGTATTACTATAAACCCAGATACT<br>TCTAAAAATCAAATTTCCCTTCAGCTCAACTCAGTTACACCAGAGGATACTGC<br>AGTCTATTATTGCGCAAGAGTTCGACCTGGCATTCCCTTCGATTATTGGGGGC<br>AGGGGACACCCGTTACTGTGTCCTCA |
| MHGB665-HL-Fc | 314 | CAGGTGCAGCTGCAGCAGAGCGGCCCTGGACTGGTGAAGCCCAGCCAGACCC<br>TGAGCCTGACCTGCGCTATCAGCGGCGATAGCGTGAGCTCCAACAGCGCCGC<br>CTGGAACTGGATCAGGCAGAGCCCTAGCAGGGGCCTGGAATGGCTGGGCAGG<br>ACCTACTACAGGAGCAAGTGGTACAACGACTACGCCGTGTCCGTGAAGAGCA<br>GGATCACCATCAACCCCGACACCAGCAAGAACCAGATCAGCCTGCAGCTGAA<br>CAGCGTGACCCCCGAGGACACCGCCGTGTACTACTGCGCCGGCGACAGAAGG<br>TACGGCATCGTGGGCCTGCCTTTCGCCTACTGGGGCCAGGGAACCCTGGTGAC<br>CGTGAGCAGCGGCGGATCTGAGGGAAAGTCCAGCGGCTCCGGCAGCGAAAG<br>CAAGTCCACCGGCGGAAGCGACATCGTGATGACCCAGAGCCCCGATAGCCTG<br>GCTGTGAGCCTGGGCGAGAGAGCCACCATCAACTGCAAGAGCAGCCAGAGCG<br>TGCTGCACAGCAGCAACAACAAGAACTACCTGACCTGGTTCCAGCAGAAGCC<br>CGGCCAGCCTCCCAAGCTGCTGATCTACTGGGCTAGCACCAGAGAGTCCGGC<br>GTGCCTGACAGGTTCAGCGGAAGCGGCAGCGGCACCGACTTCACCCTGACCA<br>TCAGCAGCCTGCAGGCCGAGGACGTGGCCGTGTACTACTGCCACCAGTACTA<br>CAGCACCCCCCCTACCTTTGGCCAGGGCACCAAGGTGGAGATCAAGGAGCCC<br>AAATCTAGCGACAAAACTCACACTTGTCCACCGTGCCCAGCACCTGAAGCAG<br>CAGGGGGACCGTCAGTCTTCCTCTTCCCCCCAAAACCCAAGGACACCCTCATG<br>ATCTCCCGGACCCCTGAGGTCACATGCGTGGTGGTGGACGTGAGCCACGAAG<br>ACCCTGAGGTCAAGTTCAACTGGTACGTGGACGGCGTGGAGGTGCATAATGC<br>CAAGACAAAGCCGCGGGAGGAGCAGTACAACAGCACGTACCGTGTGGTCAG<br>CGTCCTCACCGTCCTGCACCAGGACTGGCTGAATGGCAAGGAGTACAAGTGC<br>AAGGTGTCCAACAAAGCCCTCCCAGCCCCCATCGAGAAAACCATCTCCAAAG<br>CCAAAGGGCAGCCCCGAGAACCACAGGTGTACGTGCTGCCCCCATCCCGGGA<br>GGAGATGACCAAGAACCAGGTCAGCCTGCTGTGCCTGGTCAAAGGCTTCTAT<br>CCCAGCGACATCGCCGTGGAGTGGGAGAGCAATGGGCAGCCGGAGAACAAC<br>TACCTCACCTGGCCTCCCGTGCTGGACTCCGACGGCTCCTTCTTCCTCTACAGC<br>AAGCTCACCGTGGACAAGTCCAGATGGCAGCAGGGGAACGTCTTCTCATGCT<br>CCGTGATGCATGAGGCTCTGCACAACCACTACACGCAGAAGTCTCTCTCCCTG<br>TCTCCGGGAAAA |

TABLE 19-continued cDNA sequences of anti-HLA-G scFvs and scFv-Fcs.

| scFv or cDNA scFv-Fc | SEQ ID NO: | cDNA |
|---|---|---|
| MHGB665-LH-Fc | 315 | GACATCGTGATGACCCAGAGCCCCGATAGCCTGGCTGTGAGCCTGGGCGAGA<br>GAGCCACCATCAACTGCAAGAGCAGCCAGAGCGTGCTGCACAGCAGCAACAA<br>CAAGAACTACCTGACCTGGTTCCAGCAGAAGCCCGGCCAGCCTCCCAAGCTG<br>CTGATCTACTGGGCTAGCACCAGAGAGTCCGGCGTGCCTGACAGGTTCAGCG<br>GAAGCGGCAGCGGCACCGACTTCACCCTGACCATCAGCAGCCTGCAGGCCGA<br>GGACGTGGCCGTGTACTACTGCCACCAGTACTACAGCACCCCCCCTACCTTTG<br>GCCAGGGCACCAAGGTGGAGATCAAGGGCGGATCTGAGGGAAAGTCCAGCG<br>GCTCCGGCAGCGAAAGCAAGTCCACCGGCGGAAGCCAGGTGCAGCTGCAGCA<br>GAGCGGCCCTGGACTGGTGAAGCCCAGCCAGACCCTGAGCCTGACCTGCGCT<br>ATCAGCGGCGATAGCGTGAGCTCCAACAGCGCCGCCTGGAACTGGATCAGGC<br>AGAGCCCTAGCAGGGGCCTGGAATGGCTGGGCAGGACCTACTACAGGAGCAA<br>GTGGTACAACGACTACGCCGTGTCCGTGAAGAGCAGGATCACCATCAACCCC<br>GACACCAGCAAGAACCAGATCAGCCTGCAGCTGAACAGCGTGACCCCCGAGG<br>ACACCGCCGTGTACTACTGCGCCGGCGACAAAGGTACGGCATCGTGGGCCT<br>GCCTTTCGCCTACTGGGGCCAGGGAACCCTGGTGACCGTGAGCAGCgagcccaaat<br>ctagcgacaaaactcacacttgtccaccgtgcccagcacctgaagcagcaggggaccgtcagtcttcctcttccccccaaaac<br>ccaaggacaccctcatgatctcccggacccctgaggtcacatgcgtggtggtgagcgtgagccacgaagaccctgaggtcaag<br>ttcaactggtacgtggacggcgtggaggtgcataatgccaagacaaagccgcgggaggagcagtacaacagcacgtaccgtg<br>tggtcagcgtcctcaccgtcctgcaccaggactggctgaatggcaaggagtacaagtgcaaggtgtccaacaaagccctccca<br>gcccccatcgagaaaaccatctccaaagccaaagggcagccccgagaaccacaggtgtacgtgctgcccccatcccgggag<br>gagatgaccaagaaccaggtcagcctgctgtgcctggtcaaaggcttctatcccagcgacatcgccgtggagtgggagagcaa<br>tgggcagccggagaacaactacctcacctggcctcccgtgctggactccgacggctccttcttcctctacagcaagctcaccgtg<br>gacaagtccagatggcagcaggggaacgtcttctcatgctccgtgatgcatgaggctctgcacaaccactacacgcagaagtct<br>ctctccctgtctccgggaaaa |
| MHGB668-HL-Fc | 316 | CAGGTGCAGCTGCAGCAGAGCGGACCCGGCCTGGTGAAACCCAGCCAGACCC<br>TGAGCCTGACCTGCGCCATCAGCGGCGACAGCGTGAGCAACAACAGCGCCGC<br>CTGGAACTGGATCAGGCAGAGCCCCAGCAGAGGCCTGGAATGGCTGGGCAGG<br>ACCTACTACAGGAGCAAGTGGTACAACGACTACGCCGTGAGCGTGAAGAGCA<br>GGATCACCATCAACCCCGACACCTCCAAGAACCAGTTCAGCCTGCAGCTGAA<br>CAGCGTGACCCCCGAGGACACCGCCGTGTACTACTGCGCCAGGTATGGCAGC<br>GGCCACCCTGCTGTTCGACTACTGGGGCCAGGGCACCCTGGTGACAGTGAGCA<br>GCGGCGGATCTGAGGGAAAGTCCAGCGGCTCCGGCAGCGAAAGCAAGTCCAC<br>CGGCGGAAGCGACATCGTGATGACCCAGAGCCCCGATAGCCTGGCTGTGAGC<br>CTGGGAGAGAGGGCCACCATCAACTGCAAGAGCAGCCAGAGCGTGCTGTACA<br>GCAGCAAGAACAAGAACTACCTGGCCTGGTACCAGCAGAAACCCGGCCAGCC<br>CCCCAAGCTGCTGATCTACTGGGCCAGCACAAGGGAAAGCGGCGTGCCCGAC<br>AGATTCAGCGGAAGCGGCAGCGGCACCGACTTCACCCTGACCATCAGCAGCC<br>TGCAGGCCGAGGATGTGGCCGTGTACTACTGCCAGCAGTACTACAGCACCTTC<br>CCCTACACCTTCGGCCAGGGCACCAAGCTGGAGATCAAGgagcccaaatctagcgacaaa<br>actcacacttgtccaccgtgcccagcacctgaagcagcaggggaccgtcagtcttcctcttccccccaaaacccaaggacacc<br>ctcatgatctcccggacccctgaggtcacatgcgtggtggtgagcgtgagccacgaagaccctgaggtcaagttcaactggtac<br>gtggacggcgtggaggtgcataatgccaagacaaagccgcgggaggagcagtacaacagcacgtaccgtgtggtcagcgtc<br>ctcaccgtcctgcaccaggactggctgaatggcaaggagtacaagtgcaaggtgtccaacaaagccctcccagcccccatcga<br>gaaaaccatctccaaagccaaagggcagccccgagaaccacaggtgtacgtgctgcccccatcccgggaggagatgaccaa<br>gaaccaggtcagcctgctgtgcctggtcaaaggcttctatcccagcgacatcgccgtggagtgggagagcaatgggcagccgg<br>agaacaactacctcacctggcctcccgtgctggactccgacggctccttcttcctctacagcaagctcaccgtggacaagtccag<br>atggcagcaggggaacgtcttctcatgctccgtgatgcatgaggctctgcacaaccactacacgcagaagtctctctccctgtctc<br>cgggaaaa |
| MHGB668-LH-Fc | 317 | GACATCGTGATGACCCAGAGCCCCGATAGCCTGGCTGTGAGCCTGGGAGAGA<br>GGGCCACCATCAACTGCAAGAGCAGCCAGAGCGTGCTGTACAGCAGCAAGAA<br>CAAGAACTACCTGGCCTGGTACCAGCAGAAACCCGGCCAGCCCCCCAAGCTG<br>CTGATCTACTGGGCCAGCACAAGGGAAAGCGGCGTGCCCGACAGATTCAGCG<br>GAAGCGGCAGCGGCACCGACTTCACCCTGACCATCAGCAGCCTGCAGGCCGA<br>GGATGTGGCCGTGTACTACTGCCAGCAGTACTACAGCACCTTCCCCTACACCT<br>TCGGCCAGGGCACCAAGCTGGAGATCAAGGGCGGATCTGAGGGAAAGTCCA<br>GCGGCTCCGGCAGCGAAAGCAAGTCCACCGGCGGAAGCCAGGTGCAGCTGCA<br>GCAGAGCGGACCCGGCCTGGTGAAACCCAGCCAGACCCTGAGCCTGACCTGC<br>GCCATCAGCGGCGACAGCGTGAGCAACAACAGCGCCGCCTGGAACTGGATCA<br>GGCAGAGCCCCAGCAGAGGCCTGGAATGGCTGGGCAGGACCTACTACAGGA<br>GCAAGTGGTACAACGACTACGCCGTGAGCGTGAAGAGCAGGATCACCATCAA<br>CCCCGACACCTCCAAGAACCAGTTCAGCCTGCAGCTGAACAGCGTGACCCCC<br>GAGGACACCGCCGTGTACTACTGCGCCAGGTATGGCAGCGGCACCCTGCTGT<br>TCGACTACTGGGGCCAGGGCACCCTGGTGACAGTGAGCAGCgagcccaaatctagcgac<br>aaaactcacacttgtccaccgtgcccagcacctgaagcagcaggggaccgtcagtcttcctcttccccccaaaacccaaggac<br>accctcatgatctcccggacccctgaggtcacatgcgtggtggtgagcgtgagccacgaagaccctgaggtcaagttcaactgg<br>tacgtggacggcgtggaggtgcataatgccaagacaaagccgcgggaggagcagtacaacagcacgtaccgtgtggtcagc<br>gtcctcaccgtcctgcaccaggactggctgaatggcaaggagtacaagtgcaaggtgtccaacaaagccctcccagcccccat<br>cgagaaaaccatctccaaagccaaagggcagccccgagaaccacaggtgtacgtgctgcccccatcccgggaggagatgac<br>caagaaccaggtcagcctgctgtgcctggtcaaaggcttctatcccagcgacatcgccgtggagtgggagagcaatgggcagc<br>cggagaacaactacctcacctggcctcccgtgctggactccgacggctccttcttcctctacagcaagctcaccgtggacaagtc<br>cagatggcagcaggggaacgtcttctcatgctccgtgatgcatgaggctctgcacaaccactacacgcagaagtctctctccctgt<br>ctccgggaaaa |

TABLE 19-continued cDNA sequences of anti-HLA-G scFvs and scFv-Fcs.

| scFv or cDNA scFv-Fc | SEQ ID NO: | cDNA |
|---|---|---|
| MHGB669-HL-Fc | 318 | CAGGTGCAGCTGCAGCAGAGCGGACCCGGACTGGTGAGACCCAGCCAGACCC<br>TGAGCGTGACCTGCGCCATCAGCGGCGACAGCGTGAGCAGCAACAGCGCCAG<br>CTGGAACTGGATCAGGCAGAGCCCCAGCAGAGGCCTGGAGTGGCTGGGAAG<br>GACATACTACAGGAGCGAGTGGTTCAACGACTACGCCGTGAGCGTGAAGAGC<br>AGGGTGACCATCAACCCCGACACCAGCAAGAACCAGCTGAGCCTGCAGCTGA<br>ACAGCGTGATCCCCGAGGACACCGCCGTGTACTACTGCGCCAGAGAGGCCAG<br>AATCGGCGTGGCCGGCAAAGGCTTCGACTACTGGGGCCAGGGCACCCTGGTG<br>ACAGTGTCCAGCGGCGGATCTGAGGGAAAGTCCAGCGGCTCCGGCAGCGAAA<br>GCAAGTCCACCGGCGGAAGCGACATCGTGATGACCCAGAGCCCTGACTCCCT<br>GGCTGTGAGCCTGGGCGAGAGAGCCACCATCAACTGCAAGAGCAGCCAGAGC<br>GTGCTGTTCAGGAGCAACAACAAGAACTACCTGGCCTGGTTCCAGCAGAAGC<br>CCGGCCAGCCTCCCAAGCTGCTGATCTACTGGGCCAGCACCAGAGAGAGCGG<br>CGTGCCCGATAGATTTAGCGGCAGCGGCAGCGGCACCGACTTTACCCTGACC<br>ATCAGCTCCCTGCAGGCCGAGGATGTGGCCGTGTACTACTGCCAGCAGTACTA<br>CAGCACCCCCAGAACCTTCGGCCAGGGCACCAAGGTGGAGATCAAGgagcccaaa<br>tctagcgacaaaactcacacttgtccaccgtgcccagcacctgaagcagcaggggaccgtcagtcttcctcttcccccaaaac<br>ccaaggacaccctcatgatctcccggacccctgaggtcacatgcgtggtggtgagcgtgagccacgaagaccctgaggtcaag<br>ttcaactggtacgtggacggcgtggaggtgcataatgccaagacaaagccgcgggaggagcagtacaacagcacgtaccgtg<br>tggtcagcgtcctcaccgtcctgcaccaggactggctgaatggcaaggagtacaagtgcaaggtgtccaacaaagcctccca<br>gcccccatcgagaaaaccatctccaaagccaaagggcagccccgagaaccacaggtgtacgtgctgcccccatcccgggag<br>gagatgaccaagaaccaggtcagcctgctgtgcctggtcaaaggcttctatcccagcgacatcgccgtggagtgggagagcaa<br>tgggcagccggagaacaactacctcacctggcctccgtgctggactccgacggctccttcttcctctacagcaagctcaccgtg<br>gacaagtccagatggcagcaggggaacgtcttctcatgctccgtgatgcatgaggctctgcacaaccactacacgcagaagtct<br>ctctccctgtctccgggaaaa |
| MHGB669-LH-Fc | 319 | GACATCGTGATGACCCAGAGCCCTGACTCCCTGGCTGTGAGCCTGGGCGAGA<br>GAGCCACCATCAACTGCAAGAGCAGCCAGAGCGTGCTGTTCAGGAGCAACAA<br>CAAGAACTACCTGGCCTGGTTCCAGCAGAAGCCCGGCCAGCCTCCCAAGCTG<br>CTGATCTACTGGGCCAGCACCAGAGAGAGCGGCGTGCCCGATAGATTTAGCG<br>GCAGCGGCAGCGGCACCGACTTTACCCTGACCATCAGCTCCCTGCAGGCCGA<br>GGATGTGGCCGTGTACTACTGCCAGCAGTACTACAGCACCCCCAGAACCTTCG<br>GCCAGGGCACCAAGGTGGAGATCAAGGGCGGATCTGAGGGAAAGTCCAGCGG<br>CTCCGGCAGCGAAAGCAAGTCCACCGGCGGAAGCCAGGTGCAGCTGCAGCA<br>GAGCGGACCCGGACTGGTGAGACCCAGCCAGACCCTGAGCGTGACCTGCGCC<br>ATCAGCGGCGACAGCGTGAGCAGCAACAGCGCCAGCTGGAACTGGATCAGGC<br>AGAGCCCCAGCAGAGGCCTGGAGTGGCTGGGAAGGACATACTACAGGAGCG<br>AGTGGTTCAACGACTACGCCGTGAGCGTGAAGAGCAGGGTGACCATCAACCC<br>CGACACCAGCAAGAACCAGCTGAGCCTGCAGCTGAACAGCGTGATCCCCGAG<br>GACACCGCCGTGTACTACTGCGCCAGAGAGGCCAGAATCGGCGTGGCCGGCA<br>AAGGCTTCGACTACTGGGGCCAGGGCACCCTGGTGACAGTGTCCAGCgagcccaa<br>atctagcgacaaaactcacacttgtccaccgtgcccagcacctgaagcagcaggggaccgtcagtcttcctcttcccccaaaa<br>cccaaggacaccctcatgatctcccggacccctgaggtcacatgcgtggtggtgagcgtgagccacgaagaccctgaggtcaa<br>gacaactggtacgtggacggcgtggaggtgcataatgccaagacaaagccgcgggaggagcagtacaacagcacgtaccgt<br>gtggtcagcgtcctcaccgtcctgcaccaggactggctgaatggcaaggagtacaagtgcaaggtgtccaacaaagcctccc<br>agcccccatcgagaaaaccatctccaaagccaaagggcagccccgagaaccacaggtgtacgtgctgcccccatcccgggag<br>gagatgaccaagaaccaggtcagcctgctgtgcctggtcaaaggcttctatcccagcgacatcgccgtggagtgggagagcaa<br>tgggcagccggagaacaactacctcacctggcctcccgtgctggactccgacggctccttcttcctctacagcaagctcaccgtg<br>gacaagtccagatggcagcaggggaacgtcttctcatgctccgtgatgcatgaggctctgcacaaccactacacgcagaagtct<br>ctctccctgtctccgggaaaa |
| MHGB672-HL-Fc | 320 | CAGGTGCAGCTGCAGCAGAGCGGACCTGGCCTGGTGAAGCCCAGCCAGACCC<br>TGAGCCTGACATGCGCCATCAGCGGCGACAGCGTGAGCAGCAATAGGGCCGC<br>CTGGAACTGGATCAGGCAGACCCCTAGCAGGGGCCTGGAATGGCTGGGCAGG<br>ACATACTACAGGAGCGAGTGGTACAACGACTACGCCGTGTCCGTGAAGAGCA<br>GGATCACCATCAACCCCGACACCAGCAAGAACCAGTTCAGCCTGCAGCTGAA<br>CAGCGTGACCCCCGAGGACACCGCCGTGTACTACTGCGCCAGAGTGAGAGCC<br>GCCGTGCCTTTCGACTACTGGGGCCAGGGCACCCTGGTGACAGTGAGCAGCG<br>GCGGATCTGAGGGAAAGTCCAGCGGCTCCGGCAGCGAAAGCAAGTCCACCGG<br>CGGAAGCGACATCGTGATGACCCAGAGCCCCGATAGCCTGGCTGTGAGCCTG<br>GGCGAGAGGGCCACCATCAACTGCAAGAGCAGCCAGAGCGTGCTGTTTTCCA<br>GCAACAACAAGAACTACCTGGCCTGGTACCAGCAGAAACCCGGCCAGCCCCC<br>CAACCTGCTGATCTACTGGGCCAGCACCAGAGAAAGCGGCGTGCCCGACAGG<br>TTTAGCGGCAGCGTGAGCGGCACCGACTTCACCCTGACCATCAGCAGCCTGC<br>AGGCCGAGGACGTGGCCATCTACTACTGCCAGCAGTACCACAGCACCCCCTG<br>GACATTCGGCCAGGGCACCAAGGTGGAGATCAAGgagcccaaatctagcgacaaaactcaca<br>cttgtccaccgtgcccagcacctgaagcagcaggggaccgtcagtcttcctcttcccccaaaacccaaggacaccctcatgat<br>ctcccggacccctgaggtcacatgcgtggtggtgagcgtgagccacgaagaccctgaggtcaagttcaactggtacgtggacg<br>gcgtggaggtgcataatgccaagacaaagccgcgggaggagcagtacaacagcacgtaccgtgtggtcagcgtcctcaccgt<br>cctgcaccaggactggctgaatggcaaggagtacaagtgcaaggtgtccaacaaagcctcccagcccccatcgagaaaacc<br>atctccaaagccaaagggcagccccgagaaccacaggtgtacgtgctgcccccatcccgggaggagatgaccaagaaccag<br>gtcagcctgctgtgcctggtcaaaggcttctatcccagcgacatcgccgtggagtgggagagcaatgggcagccggagaacaa<br>ctacctcacctggcctcccgtgctggactccgacggctccttcttcctctacagcaagctcaccgtggacaagtccagatggcag<br>caggggaacgtcttctcatgctccgtgatgcatgaggctctgcacaaccactacacgcagaagtctctctccctgtctccgggaaa<br>a |

TABLE 19-continued cDNA sequences of anti-HLA-G scFvs and scFv-Fcs.

| scFv or scFv-Fc | SEQ ID NO: | cDNA |
|---|---|---|
| MHGB672-LH-Fc | 321 | GACATCGTGATGACCCAGAGCCCCGATAGCCTGGCTGTGAGCCTGGGCGAGA<br>GGGCCACCATCAACTGCAAGAGCAGCCAGAGCGTGCTGTTTTCCAGCAACAA<br>CAAGAACTACCTGGCCTGGTACCAGCAGAAACCCGGCCAGCCCCCCAACCTG<br>CTGATCTACTGGGCCAGCACCAGAGAAAGCGGCGTGCCCGACAGGTTTAGCG<br>GCAGCGTGAGCGGCACCGACTTCACCCTGACCATCAGCAGCCTGCAGGCCGA<br>GGACGTGGCCATCTACTACTGCCAGCAGTACCACAGCACCCCCTGGACATTCG<br>GCCAGGGCACCAAGGTGGAGATCAAGGGCGGATCTGAGGGAAAGTCCAGCG<br>GCTCCGGCAGCGAAAGCAAGTCCACCGGCGGAAGCCAGGTGCAGCTGCAGCA<br>GAGCGGACCTGGCCTGGTGAAGCCCAGCCAGACCCTGAGCCTGACATGCGCC<br>ATCAGCGGCGACAGCGTGAGCAGCAATAGGGCCGCCTGGAACTGGATCAGGC<br>AGACCCCTAGCAGGGGCCTGGAATGGCTGGGCAGGACATACTACAGGAGCGA<br>GTGGTACAACGACTACGCCGTGTCCGTGAAGAGCAGGATCACCATCAACCCC<br>GACACCAGCAAGAACCAGTTCAGCCTGCAGCTGAACAGCGTGACCCCCGAGG<br>ACACCGCCGTGTACTACTGCGCCAGAGTGAGAGCCGCCGTGCCTTTCGACTAC<br>TGGGGCCAGGGCACCCTGGTGACAGTGAGCAGCgagcccaaatctagcgacaaaactcacacttt<br>gtccaccgtgcccagcacctgaagcagcaggggggaccgtcagtcttcctcttccccccaaaacccaaggacaccctcatgatct<br>cccggaccccctgaggtcacatgcgtggtggtgagcgtgagccacgaagaccctgaggtcaagttcaactggtacgtggacggc<br>gtggaggtgcataatgccaagacaaagccgcggggaggagcagtacaacagcacgtaccgtgtggtcagcgtcctcaccgtcct<br>gcaccaggactggctgaatggcaaggagtacaagtgcaaggtctccaacaaagcccctcccagcccccatcgagaaaaccatct<br>ccaaagccaaagggcagccccgagaaccacaggtgtacgtgctgccccatcccgggaggagatgaccaagaaccaggtca<br>gcctgctgtgcctggtcaaaggcttctatcccagcgacatcgccgtggagtgggagagcaatgggcagccggagaacaactac<br>ctcacctggcctcccgtgctggactccgacggctccttcttcctctacagcaagctcaccgtggacaagtccagatggcagcagg<br>ggaacgtcttctcatgctccgtgatgcatgaggctctgcacaaccactacacgcagaagtctctctccctgtctccgggaaaa |
| MHGB687-HL-Fc | 322 | CAGCTGCAGCTGCAGGAGAGCGGCCCTGGACTGGTGAAGCCCAGCGAGACCC<br>TGAGCCTGATGTGCACCGTGAGCGGCGGCAGCATCACCAGCAGCAGCTACTA<br>CTGGGGATGGATCAGACAGCCCCCTGGCAAGGGCCTGGAGTGGATCGGCAAC<br>ATCTACTACAGCGGCACCACCTACTACAACCCCAGCCTGAAGAGCAGGGTGA<br>CCATCAGCGTGGACACCAGCAAGAACCAGTTCAGCCTGAAGCTGAGCAGCGT<br>GACAGCTGCCGACACCGCCGTGTACTACTGTGCCGCCGGAGCCAGAGACTTC<br>GACAGCTGGGGACAGGGCAGCCTGGTGACCGTGTCCAGCGGCGGATCTGAGG<br>GAAAGTCCAGCGGCTCCGGCAGCGAAAGCAAGTCCACCGGCGGAAGCGACA<br>TCGTGATGACCCAGAGCCCTGATAGCCTGGCCGTGAGCCTGGGAGAGAGAGC<br>CACCATCAACTGCAAGTCCTCCCAGAGCGTGCTGTACAGCTCCAGCAACAAG<br>AGCTACCTGGCCTGGTACCAGCAGAGGCCCGGACAGCCTCCCAAGCTGCTGA<br>TCTACTGGGCCAGCACCAGAGAGCGGCGTGCCTGACAGGTTTAGCGGCTC<br>CGGCTCCGGCACCGACTTTACCCTGACCATCAGCAGCCTGCAGGCCGAGGAT<br>GTGGCCGTGTACTACTGCCAGCAGTACTACAGCACCCCCAGGATGTACACCTTT<br>CGGCCAGGGCACCAAGCTGGAGATCAAGgagcccaaatctagcgacaaaactcacacttgtccacc<br>gtgcccagcacctgaagcagcaggggggaccgtcagtcttcctcttccccccaaaacccaaggacaccctcatgatctcccggac<br>ccctgaggtcacatgcgtggtggtgagcgtgagccacgaagaccctgaggtcaagttcaactggtacgtggacggcgtggagg<br>tgcataatgccaagacaaagccgcggggaggagcagtacaacagcacgtaccgtgtggtcagcgtcctcaccgtcctgcaccag<br>gactggctgaatggcaaggagtacaagtgtccaacaaagcccctcccagcccccatcgagaaaaccatctccaaagc<br>caaagggcagccccgagaaccacaggtgtacgtgctgccccatcccgggaggagatgaccaagaaccaggtcagcctgct<br>gtgcctggtcaaaggcttctatcccagcgacatcgccgtggagtgggagagcaatgggcagccggagaacaactacctcacct<br>ggcctcccgtgctggactccgacggctccttcttcctctacagcaagctcaccgtggacaagtccagatggcagcaggggaacg<br>tcttctcatgctccgtgatgcatgaggctctgcacaaccactacacgcagaagtctctctccctgtctccgggaaaa |
| MHGB687-LH-Fc | 323 | GACATCGTGATGACCCAGAGCCCTGATAGCCTGGCCGTGAGCCTGGGAGAGA<br>GAGCCACCATCAACTGCAAGTCCTCCCAGAGCGTGCTGTACAGCTCCAGCAA<br>CAAGAGCTACCTGGCCTGGTACCAGCAGAGGCCCGGACAGCCTCCCAAGCTG<br>CTGATCTACTGGGCCAGCACCAGAGAGCGGCGTGCCTGACAGGTTTAGCG<br>GCTCCGGCTCCGGCACCGACTTTACCCTGACCATCAGCAGCCTGCAGGCCGAG<br>GATGTGGCCGTGTACTACTGCCAGCAGTACTACAGCACCCCCAGGATGTACA<br>CCTTCGGCCAGGGCACCAAGCTGGAGATCAAGGGCGGATCTGAGGGAAAGTC<br>CAGCGGCTCCGGCAGCGAAAGCAAGTCCACCGGCGGAAGCCAGCTGCAGCTG<br>CAGGAGAGCGGCCCTGGACTGGTGAAGCCCAGCGAGACCCTGAGCCTGATGT<br>GCACCGTGAGCGGCGGCAGCATCACCAGCAGCAGCTACTACTGGGGATGGAT<br>CAGACAGCCCCCTGGCAAGGGCCTGGAGTGGATCGGCAACATCTACTACAGC<br>GGCACCACCTACTACAACCCCAGCCTGAAGAGCAGGGTGACCATCAGCGTGG<br>ACACCAGCAAGAACCAGTTCAGCCTGAAGCTGAGCAGCGTGACAGCTGCCGA<br>CACCGCCGTGTACTACTGTGCCGCCGGAGCCAGAGACTTCGACAGCTGGGGA<br>CAGGGCAGCCTGGTGACCGTGTCCAGCgagcccaaatctagcgacaaaactcacacttgtccaccgtg<br>cccagcacctgaagcagcaggggggaccgtcagtcttcctcttccccccaaaacccaaggacaccctcatgatctcccggacccc<br>tgaggtcacatgcgtggtggtgagcgtgagccacgaagaccctgaggtcaagttcaactggtacgtggacggcgtggaggtgc<br>ataatgccaagacaaagccgcggggaggagcagtacaacagcacgtaccgtgtggtcagcgtcctcaccgtcctgcaccagga<br>ctggctgaatggcaaggagtacaagtgcaaggtctccaacaaagcccctcccagcccccatcgagaaaaccatctccaaagc<br>aaagggcagccccgagaaccacaggtgtacgtgctgccccatcccgggaggagatgaccaagaaccaggtcagcctgctgtg<br>cctggtcaaaggcttctatcccagcgacatcgccgtggagtgggagagcaatgggcagccggagaacaactacctcacctggc<br>ctcccgtgctggactccgacggctccttcttcctctacagcaagctcaccgtggacaagtccagatggcagcaggggaacgtctt<br>ctcatgctccgtgatgcatgaggctctgcacaaccactacacgcagaagtctctctccctgtctccgggaaaa |

TABLE 19-continued cDNA sequences of anti-HLA-G scFvs and scFv-Fcs.

| scFv or cDNA scFv-Fc | SEQ ID NO: | cDNA |
|---|---|---|
| MHGB688-HL-Fc | 324 | GAGGTGCAGCTGTTGGAGTCAGGTCCAGGACTGGTGAAGCCCTCGCAGACCC<br>TCTCACTCACCTGTGTCATCTCCGGGGACAGTGTCTCTAGCAACAGAGCTGCT<br>TGGAACTGGATCAGGCAGTCCCCATCGAGAGGCCTTGAGTGGCTGGGAAGGA<br>CATACTACAGGTCCAAGTGGTATAATGATTATGCAGTATCTGTGAAAAGTCGA<br>ATAACCATCAATTCAGACACATCCAAGAACCAGATCTCCCTGCAGTTGAACTC<br>TGTGACTCCCGAGGACACGGCTGTGTATTACTGTGCAAGAGTGAGACCGGGG<br>ATCCCATTTGACTACTGGGGCCAGGGAACCCCGGTCACCGTCTCCTCAGGCGG<br>ATCTGAGGGAAAGTCCAGCGGCTCCGGCAGCGAAAGCAAGTCCACCGGCGGA<br>AGCGACATCGTGATGACCCAGTCTCCAGACTCCCTGGCTGTGTCTCTGGGCGA<br>GAGGGCCACCATCAACTGCAAGTCCAGCCAGAGTGTTTTATTCAGCTCCAACA<br>AAAAGAACTACTTAGCTTGGTACCAGCAGAAACCAGGACAGCCCCCTAAGCT<br>GCTCATTTACTGGGCATCTACCCGGGAATCCGGGGTCCCTGACCGATTCAGTG<br>GCAGCGGGTCTGGGACAGATTTCACTCTCACCATCAGCAGCCTGCAGGCTGA<br>AGATGTGGCAGTTTATTACTGTCAGCAATATAATAGTACTCCGTGGACGTTCG<br>GCCAAGGGACCAAGGTGGAGATCAAAgagcccaaatctagcgacaaaactcacacttgtccaccgtgc<br>ccagcacctgaagcagcaggggaccgtcagtcttcctcttccccccaaaacccaaggacaccctcatgatctcccggacccct<br>gaggtcacatgcgtggtggtgagcgtgagccacgaagaccctgaggtcaagttcaactggtacgtggacggcgtggaggtgc<br>ataatgccaagacaaagccgcgggaggagcagtacaacagcacgtaccgtgtggtcagcgtcctcaccgtcctgcaccagga<br>ctggctgaatggcaaggagtacaagtgcaaggtgtccaacaaagcccttccagcccccatcgagaaaaccatctccaaagcca<br>aagggcagccccgagaaccacaggtgtacgtgctgcccccatcccgggaggagatgaccaagaaccaggtcagcctgctgtg<br>cctggtcaaaggcttctatcccagcgacatcgccgtggagtgggagagcaatgggcagccggagaacaactacctcacctggc<br>tccccgtgctggactccgacggctccttcttcctctacagcaagctcaccgtggacaagtccagatggcagcaggggaacgtctt<br>ctcatgctccgtgatgcatgaggctctgcacaaccactacacgcagaagtctctctccctgtctccgggaaaa |
| MHGB688-LH-Fc | 325 | GACATCGTGATGACCCAGTCTCCAGACTCCCTGGCTGTGTCTCTGGGCGAGAG<br>GGCCACCATCAACTGCAAGTCCAGCCAGAGTGTTTTATTCAGCTCCAACAAAA<br>AGAACTACTTAGCTTGGTACCAGCAGAAACCAGGACAGCCCCCTAAGCTGCT<br>CATTTACTGGGCATCTACCCGGGAATCCGGGGTCCCTGACCGATTCAGTGGCA<br>GCGGGTCTGGGACAGATTTCACTCTCACCATCAGCAGCCTGCAGGCTGAAGA<br>TGTGGCAGTTTATTACTGTCAGCAATATAATAGTACTCCGTGGACGTTCGGCC<br>AAGGGACCAAGGTGGAGATCAAAGGCGGATCTGAGGGAAAGTCCAGCGGCT<br>CCGGCAGCGAAAGCAAGTCCACCGGCGGAAGCGAGGTGCAGCTGTTGGAGTC<br>AGGTCCAGGACTGGTGAAGCCCTCGCAGACCCTCTCACTCACCTGTGTCATCT<br>CCGGGGACAGTGTCTCTAGCAACAGAGCTGCTTGGAACTGGATCAGGCAGTC<br>CCCATCGAGAGGCCTTGAGTGGCTGGGAAGGACATACTACAGGTCCAAGTGG<br>TATAATGATTATGCAGTATCTGTGAAAAGTCGAATAACCATCAATTCAGACAC<br>ATCCAAGAACCAGATCTCCCTGCAGTTGAACTCTGTGACTCCCGAGGACACG<br>GCTGTGTATTACTGTGCAAGAGTGAGACCGGGGATCCCATTTGACTACTGGGG<br>CCAGGGAACCCCGGTCACCGTCTCCTCAgagcccaaatctagcgacaaaactcacacttgtccaccgt<br>gcccagcacctgaagcagcaggggaccgtcagtcttcctcttccccccaaaacccaaggacaccctcatgatctcccggacc<br>cctgaggtcacatgcgtggtggtgagcgtgagccacgaagaccctgaggtcaagttcaactggtacgtggacggcgtggaggt<br>gcataatgccaagacaaagccgcgggaggagcagtacaacagcacgtaccgtgtggtcagcgtcctcaccgtcctgcaccag<br>gactggctgaatggcaaggagtacaagtgcaaggtgtccaacaaagcccttccagcccccatcgagaaaaccatctccaaagc<br>caaagggcagccccgagaaccacaggtgtacgtgctgcccccatcccgggaggagatgaccaagaaccaggtcagcctgct<br>gtgcctggtcaaaggcttctatcccagcgacatcgccgtggagtgggagagcaatgggcagccggagaacaactacctcacct<br>ggctccccgtgctggactccgacggctccttcttcctctacagcaagctcaccgtggacaagtccagatggcagcaggggaacg<br>tcttctcatgctccgtgatgcatgaggctctgcacaaccactacacgcagaagtctctctccctgtctccgggaaaa |
| MHGB689-HL-Fc | 326 | CAGGTACAGCTGCAGCAGTCAGGTCCAGGACTGGTGAAGCCCTCGCAGACCC<br>TCTCACTCACCTGTGTCATCTCCGGGGACAGTGTCTCTAGCAACAGAGCTGCC<br>TGGAACTGGATCAGGCAGTCCCCATCGAGAGGCCTTGAGTGGCTGGGAAGGA<br>CATACTACAGGTCCAAGTGGTATAATGATTATGCAGTTTCTGTGAAAAGTCGA<br>ATAACCATCAATTCAGACACATCCAAGAACCAGATCTCCCTGCAGTTGAACTC<br>TGTGACTCCCGAGGACACGGCTGTGTATTACTGTGCAAGAGTGAGACCGGGG<br>ATCCCTTTTGACTACTGGGGCCAGGGAACCACGGTCACCGTCTCCTCAGGCGG<br>ATCTGAGGGAAAGTCCAGCGGCTCCGGCAGCGAAAGCAAGTCCACCGGCGGA<br>AGCGACATCCAGATGACCCAGTCTCCAGACTCCCTGGCTGTGTCTCTGGGCGA<br>GAGGGCCACCATCAACTGCGAGTCCAGCCAGAGTGTTTTATTCAGCTCCAACA<br>AAAAGAACTACTTAGCTTGGTACCAGCAGAAACCAGGACAGCCCCCTAAGCT<br>GCTCATTTACTGGGCATCTACCCGGGAATCCGGGGTCCCTGACCGATTCAGTG<br>GCAGCGGGTCTGGGACAGATTTCACTCTCACCATCAACCGCCTGCAGGCTGA<br>AGATGTGGCAGTTTATTACTGTCAGCAATATAATAGTACTCCGTGGACGTTCG<br>GCCAAGGGACCAAGGTGGAGATCAAAgagcccaaatctagcgacaaaactcacacttgtccaccgtgc<br>ccagcacctgaagcagcaggggaccgtcagtcttcctcttccccccaaaacccaaggacaccctcatgatctcccggacccct<br>gaggtcacatgcgtggtggtgagcgtgagccacgaagaccctgaggtcaagttcaactggtacgtggacggcgtggaggtgc<br>ataatgccaagacaaagccgcgggaggagcagtacaacagcacgtaccgtgtggtcagcgtcctcaccgtcctgcaccagga<br>ctggctgaatggcaaggagtacaagtgcaaggtgtccaacaaagcccttccagcccccatcgagaaaaccatctccaaagcca<br>aagggcagccccgagaaccacaggtgtacgtgctgcccccatcccgggaggagatgaccaagaaccaggtcagcctgctgtg<br>cctggtcaaaggcttctatcccagcgacatcgccgtggagtgggagagcaatgggcagccggagaacaactacctcacctggc<br>tccccgtgctggactccgacggctccttcttcctctacagcaagctcaccgtggacaagtccagatggcagcaggggaacgtctt<br>ctcatgctccgtgatgcatgaggctctgcacaaccactacacgcagaagtctctctccctgtctccgggaaaa |

TABLE 19-continued cDNA sequences of anti-HLA-G scFvs and scFv-Fcs.

| scFv or scFv-Fc | SEQ ID NO: | cDNA |
|---|---|---|
| MHGB689-LH-Fc | 327 | GACATCCAGATGACCCAGTCTCCAGACTCCCTGGCTGTGTCTCTGGGCGAGAG<br>GGCCACCATCAACTGCGAGTCCAGCCAGAGTGTTTTATTCAGCTCCAACAAAA<br>AGAACTACTTAGCTTGGTACCAGCAGAAACCAGGACAGCCCCCTAAGCTGCT<br>CATTTACTGGGCATCTACCCGGGAATCCGGGGTCCCTGACCGATTCAGTGGCA<br>GCGGGTCTGGGACAGATTTCACTCTCACCATCAACCGCCTGCAGGCTGAAGAT<br>GTGGCAGTTTATTACTGTCAGCAATATAATAGTACTCCGTGGACGTTCGGCCA<br>AGGGACCAAGGTGGAGATCAAAGGCGGATCTGAGGGAAAGTCCAGCGGCTC<br>CGGCAGCGAAAGCAAGTCCACCGGCGGAAGCCAGGTACAGCTGCAGCAGTC<br>AGGTCCAGGACTGGTGAAGCCCTCGCAGACCCTCTCACTCACCTGTGTCATCT<br>CCGGGGACAGTGTCTCTAGCAACAGAGCTGCCTGGAACTGGATCAGGCAGTC<br>CCCATCGAGAGGCCTTGAGTGGCTGGGAAGGACATACTACAGGTCCAAGTGG<br>TATAATGATTATGCAGTTTCTGTGAAAAGTCGAATAACCATCAATTCAGACAC<br>ATCCAAGAACCAGATCTCCCTGCAGTTGAACTCTGTGACTCCCGAGGACACG<br>GCTGTGTATTACTGTGCAAGAGTGAGACCGGGGATCCCTTTTGACTACTGGGG<br>CCAGGGAACCACGGTCACCGTCTCCTCAgagcccaaatctcacacttgtccaccgt<br>gcccagcacctgaagcagcaggggaccgtcagtcttcctcttccccccaaaacccaaggacaccctcatgatctcccggacc<br>cctgaggtcacatgcgtggtggtgagcgtgagccacgaagaccctgaggtcaagttcaactggtacgtggacggcgtggaggt<br>gcataatgccaagacaaagccgcgggaggagcagtacaacagcacgtaccgtgtggtcagcgtcctcaccgtcctgcaccag<br>gactggctgaatggcaaggagtacaagtgcaaggtgtccaacaaagccctcccagcccccatcgagaaaaccatctccaaagc<br>caaagggcagccccgagaaccacaggtgtacgtgctgcccccatcccgggaggagatgaccaagaaccaggtcagcctgct<br>gtgcctggtcaaaggcttctatcccagcgacatcgccgtggagtgggagagcaatgggcagccggagaacaactacctcacct<br>ggcctcccgtgctggactccgacggctccttcttcctctacagcaagctcaccgtggacaagtccagatggcagcaggggaacg<br>tcttctcatgctccgtgatgcatgaggctctgcacaaccactacacgcagaagtctctctccctgtctccgggaaaa |
| MHGB694-HL-Fc | 328 | GAGGTGCAGCTGTTGGAGTCTGGGGGAGGCTTGGTACAGCCTGGGGGGTCCC<br>TGAGACTCTCCTGTGCAGCCTCTGGATTCACCTTTAGCAGCTATGCCATGCAC<br>TGGGTCCGCCAGGCCCCAGGGAAGGGGCTGGACTGGGTCTCAGGTATTAGTG<br>GTAGTGGCTTTAGCACATACTATGTAGACTCCGTGAAGGGCCGGTTCACCATC<br>TCCAGAGACAATTCCAAGCACACGCTGTATCTGCAAATGAACAGCCTGAGAG<br>CCGAGGACACGGCCGTATATTACTGTGCGAAAGATAATTTAGTGGCTGGTAC<br>CGTCTTTGACTACTGGGGCCAGGGAACCCTGGTCACCGTCTCCTCAGGCGGAT<br>CTGAGGGAAAGTCCAGCGGCTCCGGCAGCGAAAGCAAGTCCACCGGCGGAA<br>GCGACATCCAGATGACCCAGTCTCCTTCCACCCTGTCTGCATCTGTAGGAGAC<br>AGAGTCACCATCACTTGCCGGGCCAGTCAGAGTATTAGTAGCTGGTTGGCCTG<br>GTATCAGCAGAAACCAGGGAAAGCCCCTAAGCTCCTGATCTATAAGGCGTCT<br>AGTTTAGAAAGTGGGGTCCCATCAAGGTTCAGCGGCAGTGGATCTGGGACAG<br>AATTCACTCTCACCATCAGCAGCCTGCAGCCTGATGATTTTGCAACTTATTAC<br>TGCCAACAGTATAATAGTTATTCGCTCACTTTCGGCGGAGGGACCAAGGTGG<br>ATATCAAAgagcccaaatctagcgacaaaactcacacttgtccaccgtgcccagcacctgaagcagcaggggaccgt<br>cagtcttcctcttccccccaaaacccaaggacaccctcatgatctcccggaccctgaggtcaagttcaactggtacgtggacggcgtggaggtgcataatgccaagacaaagccgcgggaggag<br>cagtacaacagcacgtaccgtgtggtcagcgtcctcaccgtcctgcaccaggactggctgaatggcaaggagtacaagtgcaa<br>ggtgtccaacaaagccctcccagcccccatcgagaaaaccatctccaaagccaaagggcagccccgagaaccacaggtgtac<br>gtgctgccccatcccgggaggagatgaccaagaaccaggtcagcctgctgtgcctggtcaaaggcttctatcccagcgacatc<br>gccgtggagtgggagagcaatgggcagccggagaacaactacctcacctggcctcccgtgctggactccgacggctccttctt<br>cctctacagcaagctcaccgtggacaagtccagatggcagcaggggaacgtcttctcatgctccgtgatgcatgaggctctgcac<br>aaccactacacgcagaagtctctctccctgtctccgggaaaa |
| MHGB694-LH-Fc | 329 | GACATCCAGATGACCCAGTCTCCTTCCACCCTGTCTGCATCTGTAGGAGACAG<br>AGTCACCATCACTTGCCGGGCCAGTCAGAGTATTAGTAGCTGGTTGGCCTGGT<br>ATCAGCAGAAACCAGGGAAAGCCCCTAAGCTCCTGATCTATAAGGCGTCTAG<br>TTTAGAAAGTGGGGTCCCATCAAGGTTCAGCGGCAGTGGATCTGGGACAGAA<br>TTCACTCTCACCATCAGCAGCCTGCAGCCTGATGATTTTGCAACTTATTACTGC<br>CAACAGTATAATAGTTATTCGCTCACTTTCGGCGGAGGGACCAAGGTGGATAT<br>CAAAGGCGGATCTGAGGGAAAGTCCAGCGGCTCCGGCAGCGAAAGCAAGTC<br>CACCGGCGGAAGCGAGGTGCAGCTGTTGGAGTCTGGGGGAGGCTTGGTACAG<br>CCTGGGGGGTCCCTGAGACTCTCCTGTGCAGCCTCTGGATTCACCTTTAGCAG<br>CTATGCCATGCACTGGGTCCGCCAGGCCCCAGGGAAGGGGCTGGACTGGGTC<br>TCAGGTATTAGTGGTAGTGGCTTTAGCACATACTATGTAGACTCCGTGAAGGG<br>CCGGTTCACCATCTCCAGAGACAATTCCAAGCACACGCTGTATCTGCAAATGA<br>ACAGCCTGAGAGCCGAGGACACGGCCGTATATTACTGTGCGAAAGATAATTT<br>AGTGGCTGGTACCGTCTTTGACTACTGGGGCCAGGGAACCCTGGTCACCGTCT<br>CCTCAgagcccaaatctagcgacaaaactcacacttgtccaccgtgcccagcacctgaagcagcaggggaccgtcagtc<br>ttcctcttccccccaaaacccaaggacaccctcatgatctcccggaccctgaggtcacatgcgtggtggtgagcgtgagccacg<br>aagaccctgaggtcaagttcaactggtacgtggacggcgtggaggtgcataatgccaagacaaagccgcgggaggagcagta<br>caacagcacgtaccgtgtggtcagcgtcctcaccgtcctgcaccaggactggctgaatggcaaggagtacaagtgcaaggtgtc<br>caacaaagccctcccagcccccatcgagaaaaccatctccaaagccaaagggcagccccgagaaccacaggtgtacgtgctg<br>cccccatcccgggaggagatgaccaagaaccaggtcagcctgctgtgcctggtcaaaggcttctatcccagcgacatcgccgt<br>ggagtgggagagcaatgggcagccggagaacaactacctcacctggcctcccgtgctggactccgacggctccttcttcctcta<br>cagcaagctcaccgtggacaagtccagatggcagcaggggaacgtcttctcatgctccgtgatgcatgaggctctgcacaacca<br>ctacacgcagaagtctctctccctgtctccgggaaaa |
| MHGB732-HL-Fc | 330 | CAAGTACAACTGCAACAAAGTGGTCCTGGGCTCGTGAAGCCTTCCCAGACTCT<br>CAGCCTCACATGCGCTATAAGTGGGGATTCTGTTTCCTCAAATTCAGCAGCCT |

TABLE 19-continued cDNA sequences of anti-HLA-G scFvs and scFv-Fcs.

| scFv or cDNA scFv-Fc | SEQ ID NO: | cDNA |
|---|---|---|
| | | GGAATTGGATACGACAGTCTCCATCCCGTGGCCTTGAGTGGCTTGGTAGAACT<br>TATTACCGATCCAAGTGGTACAATGATTACGCCGTTTCAGTGAAGTCCCGCAT<br>TACTATTAATCCCGACACATCTAAGAATCAAATTTCATTGCAACTGAATAGCG<br>TAACACCCGAAGATACAGCAGTTTATTATTGTGCAGGTGATCGACGCTACGGC<br>ATAGTGGGACTTCCTTTCGCCTATTGGGGCCAAGGGACACTGGTCACTGTGTC<br>ATCCGGCGGATCTGAGGGAAAGTCCAGCGGCTCCGGCAGCGAAAGCAAGTCC<br>ACCGGCGGAAGCGACATCGTAATGACACAGTCACCAGATTCATTGGCAGTTA<br>GTCTGGGTGAAAGGGCAACAATCAACTGCAAGTCTTCTCAGAGTGTACTGCA<br>TAGTTCTAACAATAAGAACTACCTTACCTGGTTTCAACAGAAACCAGGTCAGC<br>CCCCCAAGTTGCTGATTTACTGGGCAAGCACCCGCGAATCCGGCGTTCCCGAT<br>CGATTTTCAGGTTCCGGGAGTGGGACCGACTTTACCTTGACCATCTCTTCCTTG<br>CAGGCCGAAGATGTAGCCGTCTATTACTGCCATCAGTATTACTCTACTCCCCC<br>CACACATTCGGTCAAGGTACAAAAGTTGAGATAAAAgagcccaaatctagcgacaaaactcacac<br>ttgtccaccgtgcccagcacctgaagcagcaggggaccgtcagtcttcctcttcccccaaaacccaaggacaccctcatgatc<br>tcccgaccccctgaggtcacatgcgtggtggtgagcgtgagccacgaagaccctgaggtcaagttcaactggtacgtggacgg<br>cgtggaggtgcataatgccaagacaaagccgcgggaggagcagtacaacagcacgtaccgtgtggtcagcgtcctcaccgtc<br>ctgcaccaggactggctgaatggcaaggagtacaagtgcaaggtgtccaacaaagcccttcccagccccatcgagaaaaccat<br>ctccaaagccaaagggcagccccgagaaccacaggtgtacgtgctgccccatcccgggaggagatgaccaagaaccaggt<br>cagcctgctgtgcctggtcaaaggcttctatcccagcgacatcgccgtggagtgggagagcaatgggcagccggagaacaact<br>acctcacctggcctcccgtgctggactccgacggctccttcttcctctacagcaagctcaccgtggacaagtccagatggcagca<br>ggggaacgtcttctcatgctccgtgatgcatgaggctctgcacaaccactacacgcagaagtctctctccctgtctccgggaaaa |
| MHGB732-LH-Fc | 331 | GACATCGTAATGACACAGTCACCAGATTCATTGGCAGTTAGTCTGGGTGAAA<br>GGGCAACAATCAACTGCAAGTCTTCTCAGAGTGTACTGCATAGTTCTAACAAT<br>AAGAACTACCTTACCTGGTTTCAACAGAAACCAGGTCAGCCCCCCAAGTTGCT<br>GATTTACTGGGCAAGCACCCGCGAATCCGGCGTTCCCGATCGATTTTCAGGTT<br>CCGGGAGTGGGACCGACTTTACCTTGACCATCTCTTCCTTGCAGGCCGAAGAT<br>GTAGCCGTCTATTACTGCCATCAGTATTACTCTACTCCCCCCACATTCGGTCAA<br>GGTACAAAAGTTGAGATAAAAGGCGGATCTGAGGGAAAGTCCAGCGGCTCCG<br>GCAGCGAAAGCAAGTCCACCGGCGGAAGCCAAGTACAACTGCAACAAAGTG<br>GTCCTGGGCTCGTGAAGCCTTCCCAGACTCTCAGCCTCACATGCGCTATAAGT<br>GGGGATTCTGTTTCCTCAAATTCAGCAGCCTGGAATTGGATACGACAGTTCC<br>ATCCCGTGGCCTTGAGTGGCTTGGTAGAACTTATTACCGATCCAAGTGGTACA<br>ATGATTACGCCGTTTCAGTGAAGTCCCGCATTACTATTAATCCCGACACATCT<br>AAGAATCAAATTTCATTGCAACTGAATAGCGTAACACCCGAAGATACAGCAG<br>TTTATTATTGTGCAGGTGATCGACGCTACGGCATAGTGGGACTTCCTTTCGCC<br>TATTGGGGCCAAGGGACACTGGTCACTGTGTCATCCgagcccaaatctagcgacaaaactca<br>cacttgtccaccgtgcccagcacctgaagcagcaggggaccgtcagtcttcctcttcccccaaaacccaaggacaccctcat<br>gatctcccggaccccctgaggtcacatgcgtggtggtgagcgtgagccacgaagaccctgaggtcaagttcaactggtacgtgga<br>cggcgtggaggtgcataatgccaagacaaagccgcgggaggagcagtacaacagcacgtaccgtgtggtcagcgtcctcacc<br>gtcctgcaccaggactggctgaatggcaaggagtacaagtgcaaggtgtccaacaaagcccttcccagccccatcgagaaaac<br>catctccaaagccaaagggcagccccgagaaccacaggtgtacgtgctgccccatcccgggaggagatgaccaagaaccaggt<br>cagcctgctgtgcctggtcaaaggcttctatcccagcgacatcgccgtggagtgggagagcaatgggcagccggagaacaact<br>acctcacctggcctcccgtgctggactccgacggctccttcttcctctacagcaagctcaccgtggacaagtccagatggcagca<br>ggggaacgtcttctcatgctccgtgatgcatgaggctctgcacaaccactacacgcagaagtctctctccctgtctccgggaaa<br>aa |
| MHGB737-HL-Fc | 332 | GAGGTGCAACTCCTTGAATCAGGCGGAGGACTCGTCCAACCTGGAGGGAGTC<br>TTAGGCTTAGCTGTGCAGCCAGTGGCTTTACTTTTAGCAGCTATGCAATGCAC<br>TGGGTCAGGCAGGCTCCTGGTAAGGGGCTCGAATGGGTCAGCGGCATATCCG<br>GGTCAGGTTTCTCTACATATTATGTCGATTCTGTAAAAGGACGATTCACCATA<br>TCCAGAGACAATTCTAAAAATACCTTGTATCTCCAGATGAACAGCCTGAGAG<br>CAGAAGATACCCAGTTTATTACTGTGCAAAGGATAATCTGGTTGCCGGGAC<br>AGTTTTTGATTATTGGGGCAAGGCACCCTCGTCACAGTATCCAGTGGCGGAT<br>CTGAGGGAAAGTCCAGCGGCTCCGGCAGCGAAAGCAAGTCCACCGGCGGAA<br>GCGATATTCAGATGACTCAATCACCTTCAACCCTTAGCGCCTCCGTTGGAGAT<br>CGCGTTACCATTACCTGCCGAGCCTCCCAAAGTATCAGCTCATGGTTGGCATG<br>GTATCAACAGAAGCCTGGAAAGGCACCCAAACTTCTGATTTACAAAGCCAGC<br>TCCTTGGAGTCAGGAGTCCCAAGCCGGTTCAGCGGATCTGGGTCAGGGACAG<br>AATTTACCCTGACCATATCTTCCCTTCAGCCCGACGACTTCGCCACTTACTATT<br>GTCAGCAATACAACTCCTATTCCCTGACTTTCGGCGGTGGCACAAAGGTTGAC<br>ATCAAGgagcccaaatctagcgacaaaactcacacttgtccaccgtgcccagcacctgaagcagcaggggaccgtcag<br>tcttcctcttcccccaaaacccaaggacaccctcatgatctcccggaccccctgaggtcacatgcgtggtggtgagcgtgagcca<br>cgaagaccctgaggtcaagttcaactggtacgtggacggcgtggaggtgcataatgccaagacaaagccgcgggaggagca<br>gtacaacagcacgtaccgtgtggtcagcgtcctcaccgtcctgcaccaggactggctgaatggcaaggagtacaagtgcaaggt<br>gtccaacaaagcccttcccagccccatcgagaaaaccatctccaaagccaaagggcagccccgagaaccacaggtgtacgtg<br>ctgccccatcccgggaggagatgaccaagaaccaggtcagcctgctgtgcctggtcaaaggcttctatcccagcgacatcgcc<br>gtggagtgggagagcaatgggcagccggagaacaactacctcacctggcctcccgtgctggactccgacggctccttcttcctc<br>tacagcaagctcaccgtggacaagtccagatggcagcaggggaacgtcttctcatgctccgtgatgcatgaggctctgcacaac<br>cactacacgcagaagtctctctccctgtctccgggaaaa |
| MHGB737-LH-Fc | 333 | GATATTCAGATGACTCAATCACCTTCAACCCTTAGCGCCTCCGTTGGAGATCG<br>CGTTACCATTACCTGCCGAGCCTCCCAAAGTATCAGCTCATGGTTGGCATGGT<br>ATCAACAGAAGCCTGGAAAGGCACCCAAACTTCTGATTTACAAAGCCAGCTC |

TABLE 19-continued cDNA sequences of anti-HLA-G scFvs and scFv-Fcs.

| scFv or cDNA scFv-Fc | SEQ ID NO: | cDNA |
|---|---|---|
| | | CTTGGAGTCAGGAGTCCCAAGCCGGTTCAGCGGATCTGGGTCAGGGACAGAA<br>TTTACCCTGACCATATCTTCCCTTCAGCCCGACGACTTCGCCACTTACTATTGT<br>CAGCAATACAACTCCTATTCCCTGACTTTCGGCGGTGGCACAAAGGTTGACAT<br>CAAGGGCGGATCTGAGGGAAAGTCCAGCGGCTCCGGCAGCAAAGCAAGTC<br>CACCGGCGGAAGCGAGGTGCAACTCCTTGAATCAGGCGGAGGACTCGTCCAA<br>CCTGGAGGGAGTCTTAGGCTTAGCTGTGCAGCCAGTGGCTTTACTTTTAGCAG<br>CTATGCAATGCACTGGGTCAGGCAGGCTCCTGGTAAGGGGCTCGAATGGGTC<br>AGCGGCATATCCGGGTCAGGTTTCTCTACATATTATGTCGATTCTGTAAAAGG<br>ACGATTCACCATATCCAGAGACAATTCTAAAAATACCTTGTATCTCCAGATGA<br>ACAGCCTGAGAGCAGAAGATACCGCAGTTTATTACTGTGCAAAGGATAATCT<br>GGTTGCCGGGACAGTTTTTGATTATTGGGGGCAAGGCACCCTCGTCACAGTAT<br>CCAGTgagcccaaatctagcgacaaaactcacacttgtccaccgtgcccagcacctgaagcagcaggggaccgtcagtc<br>ttcctcttccccccaaaacccaaggacaccctcatgatctcccggaccctgaggtcacatgcgtggtggtgagcgtgagccacg<br>aagaccctgaggtcaagttcaactggtacgtggacggcgtggaggtgcataatgccaagacaaagccgcgggaggagcagta<br>caacagcacgtaccgtgtggtcagcgtcctcaccgtcctgcaccaggactggctgaatggcaaggagtacaagtgcaaggtgtc<br>caacaaagccctcccagcccccatcgagaaaaccatctccaaagccaaaggtgcagccccgagaaccacaggtgtacgtgctg<br>cccccatcccgggaggagatgaccaagaaccaggtcagcctgctgtgcctggtcaaaggcttctatcccagcgacatcgccgt<br>ggagtgggagagcaatgggcagccggagaacaactacctcacctggcctcccgtgctggactccgacggctccttcttcctcta<br>cagcaagctcaccgtggacaagtccagatggcagcaggggaacgtcttctcatgctccgtgatgcatgaggctctgcacaacca<br>ctacacgcagaagtctctctccctgtctccgggaaaa |
| MHGB738-<br>HL-Fc | 334 | CAGGTGCAGCTTCAACAGAGCGGACCTGGTCTGGTTAAGCCTTCCCAAACCCT<br>GAGCCTGACTTGTGCTATTTCCGGGGATAGTGTTAGCTCCAATAGGGCAGCAT<br>GGAACTGGATCAGACAGTCCCCAAGCCGTGGACTTGAGTGGCTTGGACGTAC<br>TTATTACAGGAGTAAATGGTACAATGATTATGCCGTTTCTGTGAAGAGCGTA<br>TTACTATAAACCCAGATACTTCTAAAAATCAAATTTCCCTTCAGCTCAACTCA<br>GTTACACCAGAGGATACTGCAGTCTATTATTGCGCAAGAGTTCGACCTGGCAT<br>TCCCTTCGATTATTGGGGGCAGGGGACACCCGTTACTGTGTCCTCAGGCGGAT<br>CTGAGGGAAAGTCCAGCGGCTCCGGCAGCAAAGCAAGTCCACCGGCGGAA<br>GCGATATTGTTATGACACAGTCCCCAGATTCATTGGCAGTAAGCCTCGGTGAA<br>CGGGCTACTATTAACTGTAAGTCTTCCCAGAGTGTATTGTTCTCTTCAAATAA<br>CAAAAACTACCTGGCATGGTATCAGCAAAAGCCTGGTCAACCCCCTAAACTT<br>CTCATATACTGGGCATCCACTCGGGAGAGCGGTGTGCCAGACCGTTTCTCAGG<br>GAGTGTGTCAGGTACAGATTTTACACTCACAATTTCCAGCCTCCAAGCCGAAG<br>ACGTTGCAGTATATTATTGCCAACAATATCACTCTACACCTTGGACATTTGGT<br>CAAGGTACTAAAGTCGAAATCAAAgagcccaaatctagcgacaaaactcacacttgtccaccgtgccca<br>gcacctgaagcagcaggggaccgtcagtcttcctcttccccccaaaacccaaggacaccctcatgatctcccggaccctgag<br>gtcacatgcgtggtggtgagcgtgagccacgaagaccctgaggtcaagttcaactggtacgtggacggcgtggaggtgcataa<br>tgccaagacaaagccgcgggaggagcagtacaacagcacgtaccgtgtggtcagcgtcctcaccgtcctgcaccaggactgg<br>ctgaatggcaaggagtacaagtgcaaggtgtccaacaaagccctcccagcccccatcgagaaaaccatctccaaagccaaagg<br>gcagccccgagaaccacaggtgtacgtgctgcccccatcccgggaggagatgaccaagaaccaggtcagcctgctgtgcctg<br>gtcaaaggcttctatcccagcgacatcgccgtggagtgggagagcaatgggcagccggagaacaactacctcacctggcctcc<br>cgtgctggactccgacggctccttcttcctctacagcaagctcaccgtggacaagtccagatggcagcaggggaacgtcttctca<br>tgctccgtgatgcatgaggctctgcacaaccactacacgcagaagtctctctccctgtctccgggaaaa |
| MHGB738-<br>LH-Fc | 335 | GATATTGTTATGACACAGTCCCCAGATTCATTGGCAGTAAGCCTCGGTGAACG<br>GGCTACTATTAACTGTAAGTCTTCCCAGAGTGTATTGTTCTCTTCAAATAACA<br>AAAACTACCTGGCATGGTATCAGCAAAAGCCTGGTCAACCCCCTAAACTTCTC<br>ATATACTGGGCATCCACTCGGGAGAGCGGTGTGCCAGACCGTTTCTCAGGGA<br>GTGTGTCAGGTACAGATTTTACACTCACAATTTCCAGCCTCCAAGCCGAAGAC<br>GTTGCAGTATATTATTGCCAACAATATCACTCTACACCTTGGACATTTGGTCA<br>AGGTACTAAAGTCGAAATCAAAGGCGGATCTGAGGGAAAGTCCAGCGGCTCC<br>GGCAGCAAAGCAAGTCCACCGGCGGAAGCCAGGTGCAGCTTCAACAGAGC<br>GGACCTGGTCTGGTTAAGCCTTCCCAAACCCTGAGCCTGACTTGTGCTATTTC<br>CGGGGATAGTGTTAGCTCCAATAGGGCAGCATGGAACTGGATCAGACAGTCC<br>CCAAGCCGTGGACTTGAGTGGCTTGGACGTACTTATTACAGGAGTAAATGGT<br>ACAATGATTATGCCGTTTCTGTGAAGAGCGTATTACTATAAACCCAGATACT<br>TCTAAAAATCAAATTTCCCTTCAGCTCAACTCAGTTACACCAGAGGATACTGC<br>AGTCTATTATTGCGCAAGAGTTCGACCTGGCATTCCCTTCGATTATTGGGGGC<br>AGGGGACACCCGTTACTGTGTCCTCAgagcccaaatctagcgacaaaactcacacttgtccaccgtgccc<br>cagcacctgaagcagcaggggaccgtcagtcttcctcttccccccaaaacccaaggacaccctcatgatctcccggacccctg<br>aggtcacatgcgtggtggtgagcgtgagccacgaagaccctgaggtcaagttcaactggtacgtggacggcgtggaggtgcat<br>aatgccaagacaaagccgcgggaggagcagtacaacagcacgtaccgtgtggtcagcgtcctcaccgtcctgcaccaggact<br>ggctgaatggcaaggagtacaagtgcaaggtgtccaacaaagccctcccagcccccatcgagaaaaccatctccaaagccaaa<br>gggcagccccgagaaccacaggtgtacgtgctgcccccatcccgggaggagatgaccaagaaccaggtcagcctgctgtgcc<br>tggtcaaaggcttctatcccagcgacatcgccgtggagtgggagagcaatgggcagccggagaacaactacctcacctggcct<br>cccgtgctggactccgacggctccttcttcctctacagcaagctcaccgtggacaagtccagatggcagcaggggaacgtcttct<br>catgctccgtgatgcatgaggctctgcacaaccactacacgcagaagtctctctccctgtctccgggaaaa |

Example 4. Biophysical Characterization of Anti-HLA-G Antibodies

Thermal Stability of Anti-HLA-G Antibodies.

The original and germline-optimized v-regions were screened for thermal stability in scFv format. Briefly, v-regions were cloned into scFv format and were expressed in *E. coli*. The culture supernatants were assessed by ELISA for their abilities to bind recombinant HLA-G. Supernatant samples were also heat shocked at either 55, 60, or 65° C., and the binding of the heat-shocked samples was compared to the unheated samples. This analysis provided an estimate of the thermal stability of the v-regions when formatted as scFv. Based on this analysis, MHGB732, MHGB737 and MHGB738, the germline-optimized versions of MHGB694 and MHGB688, respectively, were preferred.

FIG. 1 and Table 20 show the ability of v-regions to bind recombinant HLA-G after heat treatment when formatted as scFv. V-regions were expressed as scFv in the supernatant from *E. coli* and were analyzed for their ability to bind recombinant HLA-G by ELISA. Samples were tested at room temperature or after heat treatment for 10 min at 55, 60, or 65° C. B23 was an isotype control.

TABLE 20

Analysis of antigen binding after heat treatment by v-regions formatted as scFv.

| Antibody parent of scFv | Room temperature binding signal | % Binding retained | | |
|---|---|---|---|---|
| | | 55° C. | 60° C. | 65° C. |
| MHGB665/ MHGB732 | 15215600 | 103 | 122 | 11 |
| MHGB668 | | No binding | | |
| MHGB669 | | No binding | | |
| MHGB672 | | No binding | | |
| MHGB687 | | No binding | | |
| MHGB688 | | No binding | | |
| MHGB689 | 3073733 | 2 | 3 | 4 |
| MHGB694 | 3073733 | 85 | 9 | 4 |
| MHGB737 (GL optimized B694) | 2747333 | 84 | 80 | 48 |
| MHGB738 (GL optimized B688) | 5758400 | 14 | 2 | 1 |

Binding Specificity and Affinity

The v-regions in IgG1 mAb format were tested for their abilities to specifically bind cells expressing HLA-G but not other MHC class I molecules (Table 21). Briefly, $1.5 \times 10^7$ cells were washed 2 times with 1×PBS and resuspended in 7 mL of 1×PBS and incubated for 10 min. After incubation, 8 mL of fetal bovine serum (FBS) were added, cells were washed by centrifugation at 300×g for 5 min and resuspended at $1 \times 10^6$ cells/mL in DMEM supplemented with 10% FBS. Cells were then washed by centrifugation at 300×g for 5 min and resuspended in staining buffer supplemented with goat anti-human Fc A647 (Jackson cat. #109-606-098) and incubated for 30 min at 4° C. After incubation, 150 μL of staining buffer were added and cells were washed by centrifugation at 300×g for 5 min. Cells were resuspended in 200 μL of running buffer (staining buffer supplemented with 1 mM EDTA, 0.1% (v/v) pluronic acid) and washed by centrifugation at 300×g for 5 min. Cells were resuspended in 30 mL of running buffer and analyzed for antibody binding by flow cytometry.

TABLE 21

Cell-based selectivity of anti-HLA-G antibodies. Geomean fluorescence signal reports maximum value for binding.

| Antibody | HLA-G | HLA-A | HLA-B | HLA-C |
|---|---|---|---|---|
| MHGB665/ MHGB732 GeoMean | 631628 | 9956 | 10436 | 11586 |
| MHGB668 GeoMean | 590753 | 4574 | 6323 | 4941 |
| MHGB669 GeoMean | 616340 | 8142 | 8312 | 10950 |
| MHGB672 GeoMean | 522292 | 158 | 4263 | 2447 |
| MHGB687 GeoMean | 527964 | 28765 | 22936 | 35939 |
| MHGB688 GeoMean | 481619 | 2860 | 6290 | 2226 |
| MHGB689 GeoMean | 536504 | 2541 | 5787 | 266 |
| MHGB694 GeoMean | 472613 | 2874 | 4853 | 3974 |

Next, the v-regions were tested for their abilities to bind recombinant HLA-G as mAbs using surface plasmon resonance (SPR). SPR is a label-free technique to study the strength of an interaction between two binding partners by measuring the change in mass upon complex formation and dissociation. Briefly, antibodies were immobilized on a sensor chip, which was coupled with goat anti-human Fc. Soluble HLA-G1 extracellular domain (MHGW8) was flowed over the immobilized antibody and association/dissociation responses were monitored. Kinetic information (on-rate and off-rate constants) were extracted by fitting sensorgrams to the 1:1 Langmuir model. Binding affinity ($K_D$) were reported as the ratio of rate constants ($k_{off}/k_{on}$). Antibody affinities ($K_a$) ranged from ~77 pM-2.6 nM and are shown in Table 22.

TABLE 22

SPR-based affinity measurements of variable regions binding to HLA-G (MHGW8).

| Antibody | ka (1/Ms) | kd (1/s) | KD (M) |
|---|---|---|---|
| MHGB665/ MHGB732 | 5.18E+05 | 4.00E−05 | 7.71E−11 |
| MHGB669 | 3.15E+05 | 4.53E−04 | 1.44E−09 |
| MHGB672 | 3.25E+06 | 1.79E−03 | 5.50E−10 |
| MHGB687 | 1.89E+05 | 1.53E−04 | 8.09E−10 |
| MHGB688 | 6.58E+05 | 2.63E−04 | 4.00E−10 |
| MHGB694 | 2.08E+06 | 2.40E−03 | 1.15E−09 |
| MHGB737 | 1.996E+5 | 3.103E−4 | 2.555E−9 |
| MHGB738 | 2.03E+10 | 2.83E+00 | 1.39E−10 |

Example 5. Ligand Blocking

HLA-G is over-expressed on certain tumor types and can thus serve as a marker for tumor cells. Additionally, HLA-G binds to the ligands ILT2 and ILT4, which are expressed on immune effector cells such as NK cells[4,5]. The interaction between HLA-G and ILT2/ILT4 leads to inhibition of NK cell activity. Thus, we hypothesized that antibodies which bind to HLA-G competitively with ILT2/4 would prevent inhibitory interaction between tumor cells and NK cells and lead to increased NK mediated tumor cell killing. To address this hypothesis, we first assayed whether the antibodies could block interaction between HLA-G and ILT2/4 using a competition assay. Binding between the HLA-G-dextramer complex and HEK293T cells exogenously expressing ILT2 or ILT4 receptors results in a fluorescence signal. Addition of a mAb which competes with the interaction between HLA-G-dextramer and ILT-2/4 cells results in a decrease in fluorescence signal. The inverse of the fluorescence signal inhibition was related to the ligand blocking inhibition of the mAbs (Table 22). Briefly, recombinant biotinylated HLA-G1 (MHGW8) was bound up to a streptavidin APC-dextramer (Immudex cat. #DX01-APC) to a final ratio of approximately 4 HLA-G1 proteins per dextramer molecule. Dextramer-HLA-G complex was mixed with HEK293T cells exogenously expressing ILT-2 or cells exogenously expressing ILT-4 and incubated for 30 min. at 4° C. Anti-HLA-G antibody was added at each concentration and incubated with dextramer-HLA-G complex for 30 min at ° C. Cells were added (25,000 cells) and incubated for 30 min at 4° C. After incubation, the mixture of cells and dextramer HLA-G complex were washed by centrifugation resuspended in 30 µL of running buffer (Thermo BD cat. #554657). The resuspended mixture was analyzed for fluorescence signal by flow cytometry using an Intellicyt® iQue Screener Plus. Gating was done first on singlet cells, then live cells using Sytox™ Blue Dead Cell stain (ThermoFisher), then on GFP for cells expressing ILT-2/4, then on APC for bound dextramer-HLA-G complex. All antibodies except MHGB737 could inhibit HLA-G interaction with ILT4, and all antibodies except MHGB737 and MHGB687 could inhibit interaction with ILT2 (Table 23). This suggested that antibodies discovered in this campaign could both target tumors and relieve immune inhibition by the tumor cells.

TABLE 23

Ligand blocking properties of antibodies

| Antibody | ILT2 EC50 (nM) | ILT4 EC50 (nM) |
|---|---|---|
| MHGB665 | 1.62 | 1.74 |
| MHGB669 | 1.70 | 1.59 |
| MHGB672 | 2.12 | 1.61 |
| MHGB687 | NA | 1.86 |
| MHGB688 | 1.72 | 1.42 |
| MHGB694 | 0.64 | 0.20 |
| MHGB732 | 0.33 | 0.44 |
| MHGB737 | NA | NA |
| MHGB738 | 0.73 | 0.8 |

Example 6. Epitope Mapping

Figure 2:
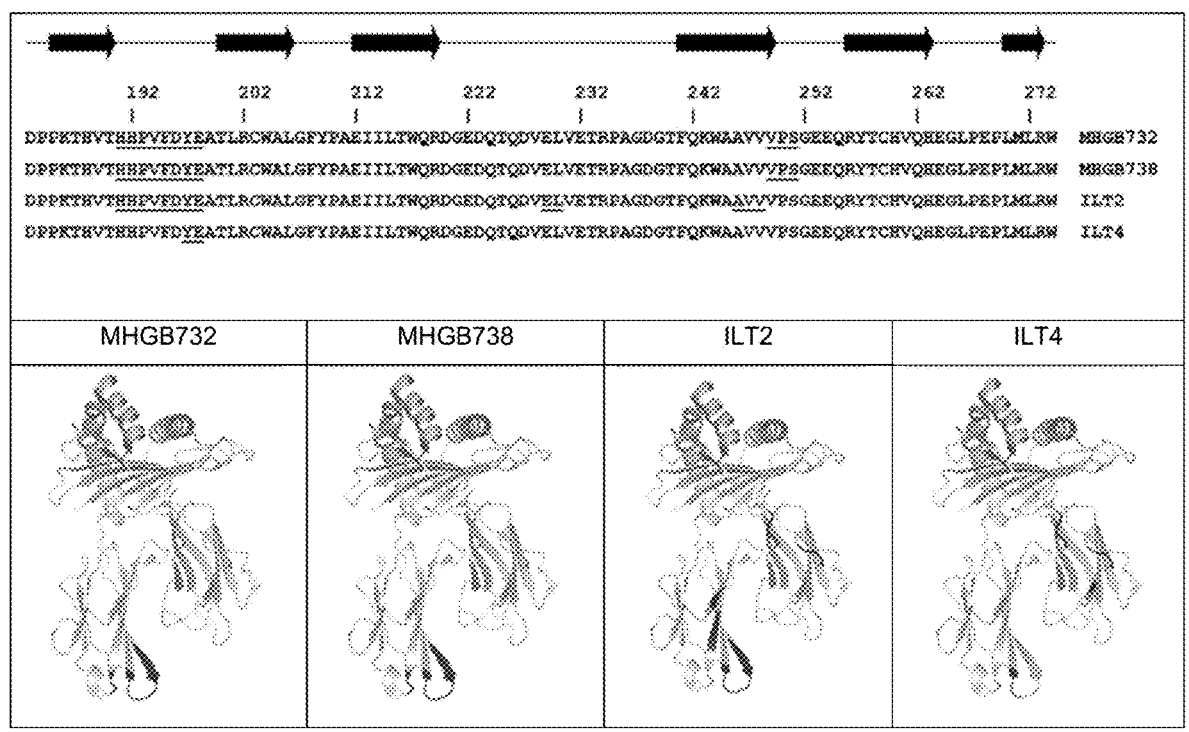
FIG. 2 shows the epitope mapping of select antibodies on HLA-G (SEQ ID NO: 1) using the hydrogen-deuterium exchange-based LC-MS. The sequence shown is the fragment of SEQ ID NO: 1, with the amino acid residue numbering staring from the first residue of the mature HLA-G (residues 183-274 are shown, SEQ ID NO: 497).
Figure 3A:
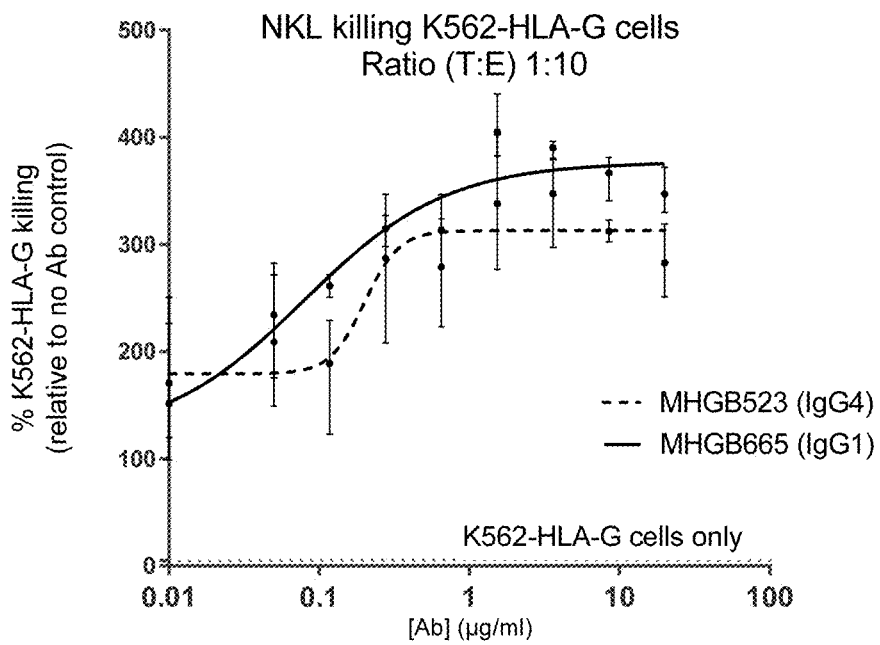
FIGS. 3A-3B show the enhancement of NK cell-mediated cytotoxicity of K562-HLA-G cells by the MHGB665-derived variable region engineered on either IgG1 (MHGB665) or IgG4 (MHGB523).
Figure 3B:
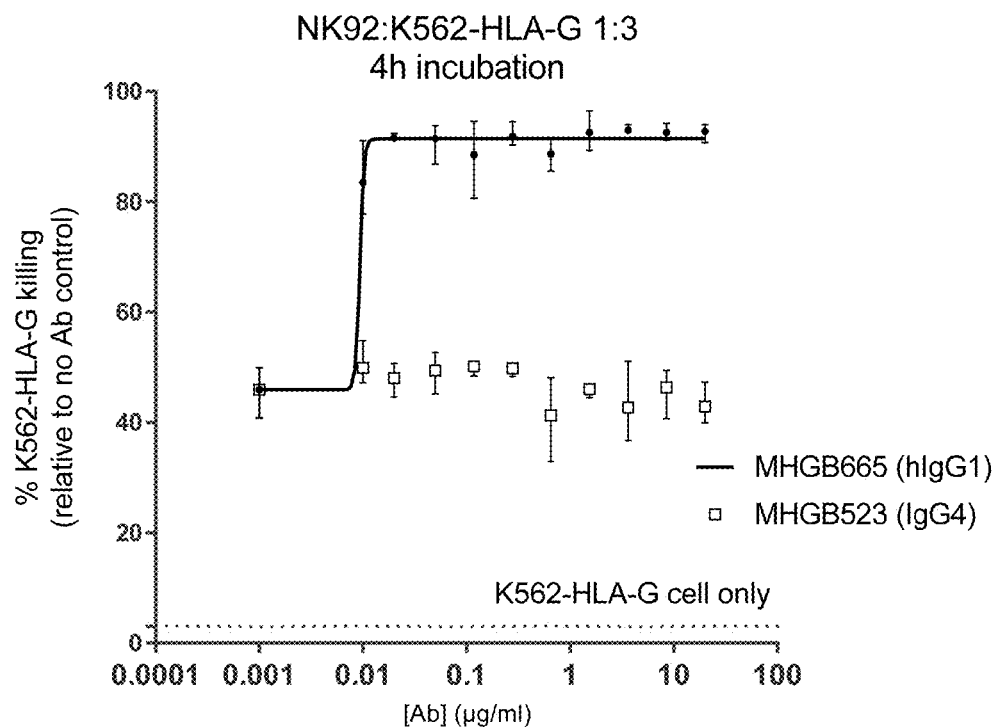
Figure 4A:
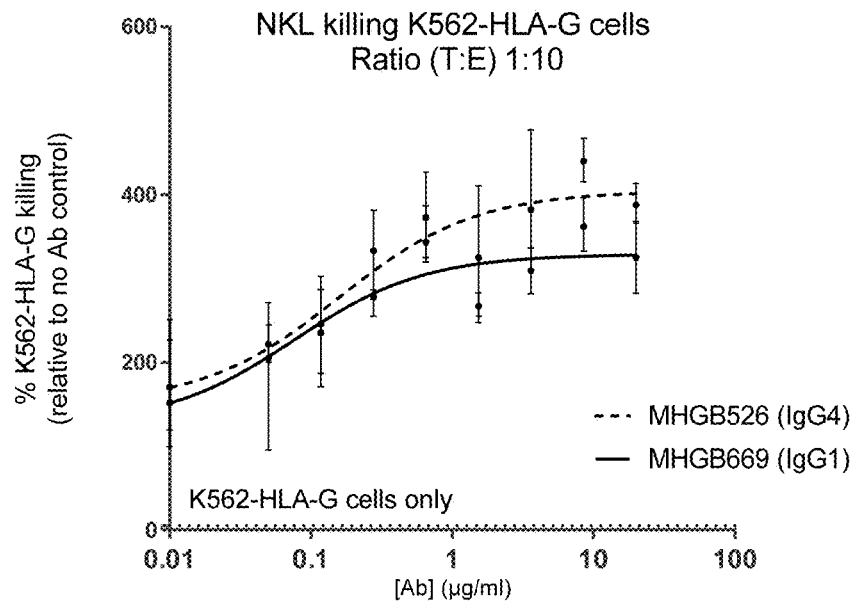
FIGS. 4A-4B show the enhancement of NK cell-mediated cytotoxicity of K562-HLA-G cells by the MHGB669-derived variable region engineered on either IgG1 (MHGB669) or IgG4 (MHGB526).
Figure 4B:
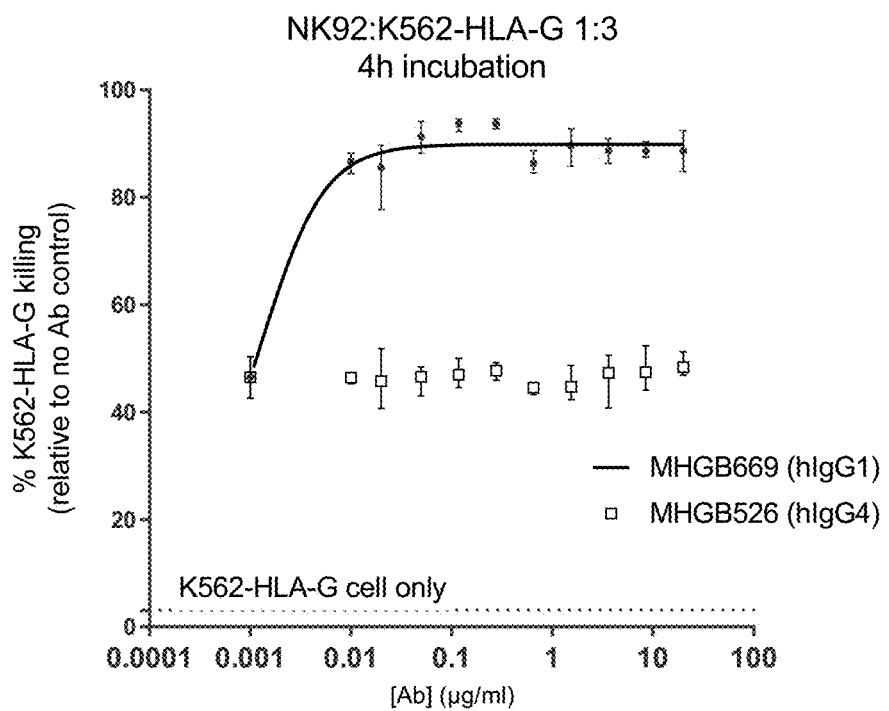
Figure 5A:
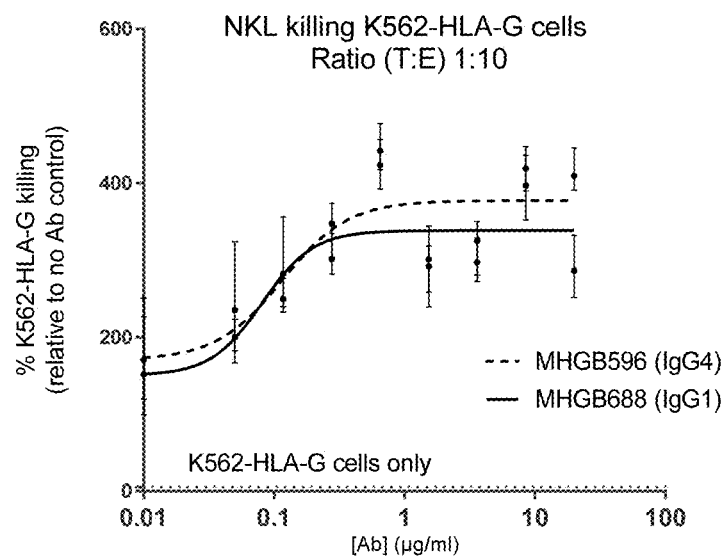
FIGS. 5A-5B show the enhancement of NK cell-mediated cytotoxicity of K562-HLA-G cells by the MHGB688-derived variable region engineered on either IgG1 (MHGB688) or IgG4 (MHGB596).
Figure 5B:
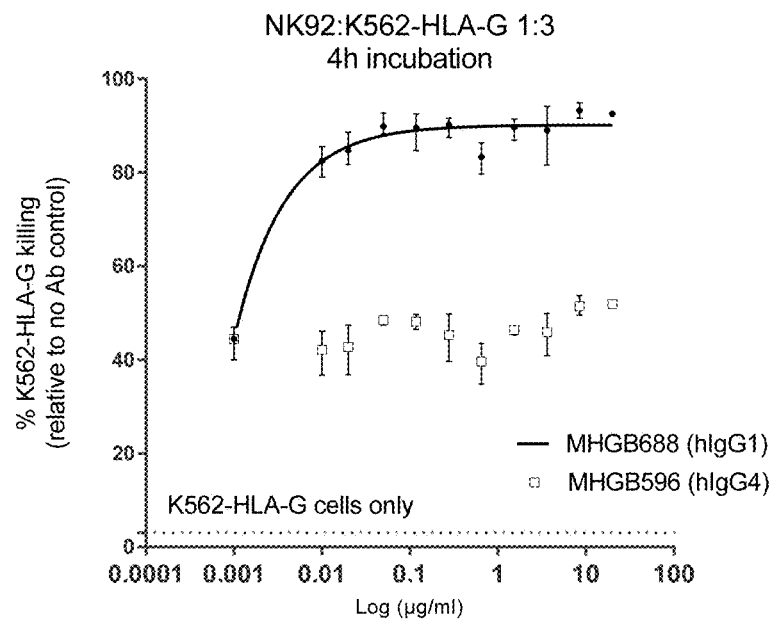
Figure 6A:
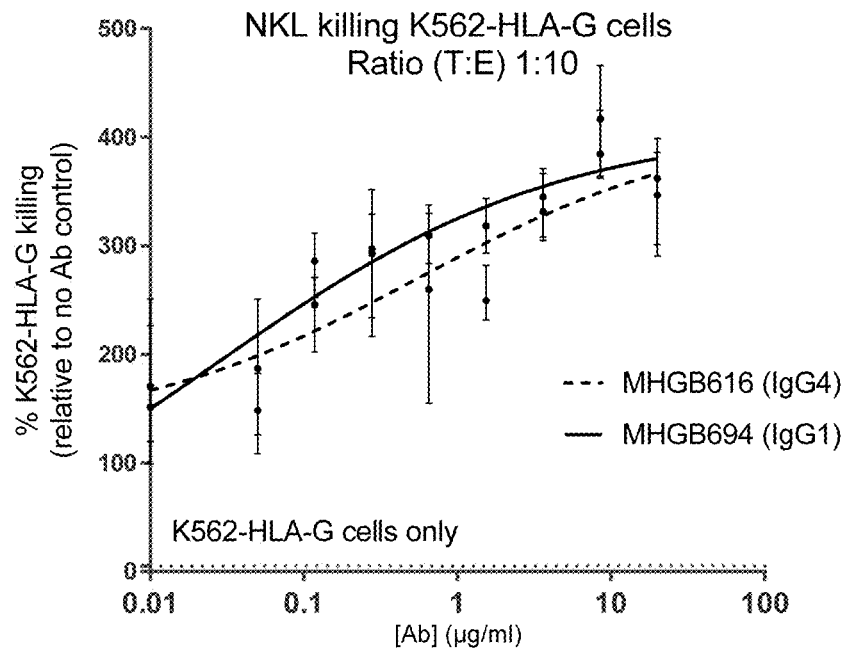
FIGS. 6A-6B show the enhancement of NK cell-mediated cytotoxicity of K562-HLA-G cells by the MHGB694-derived variable region engineered on either IgG1 (MHGB694) or IgG4 (MHGB616).
Figure 6B:
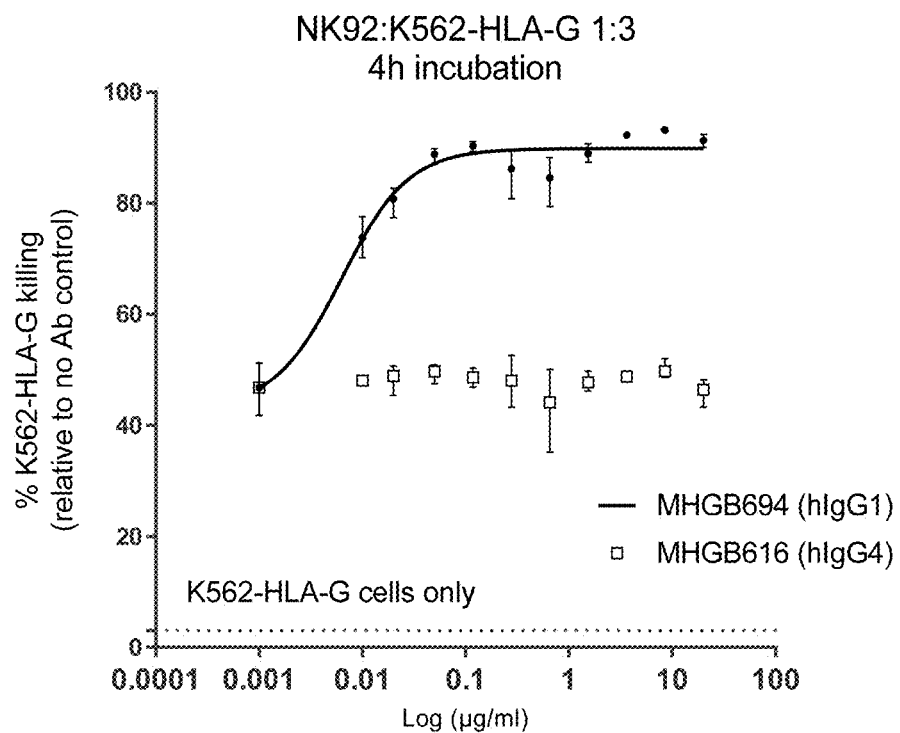
Figure 7A:
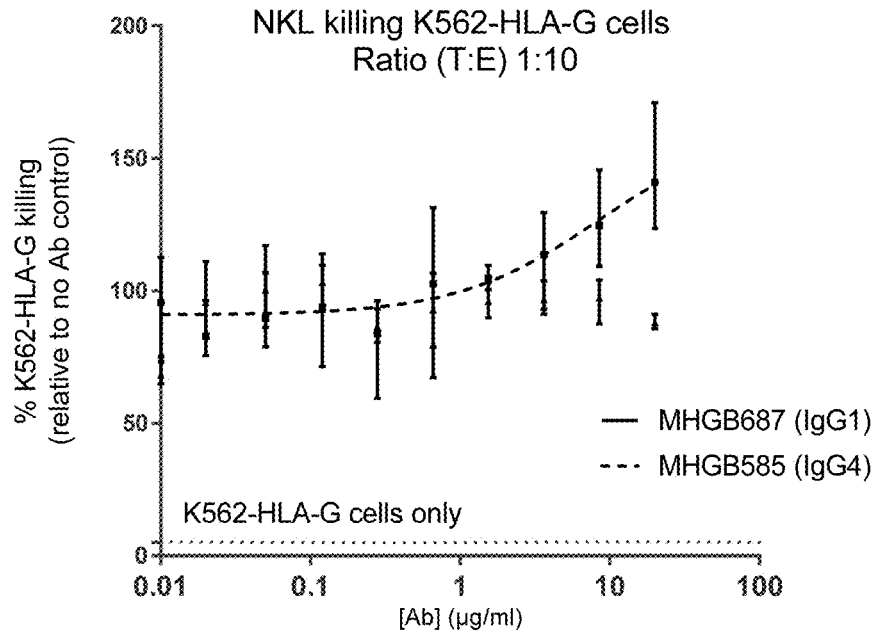
FIGS. 7A-7B show the enhancement of NK cell-mediated cytotoxicity of K562-HLA-G cells by the MHGB687-derived variable region engineered on either IgG1 (MHGB687) or IgG4 (MHGB585).
Figure 7B:
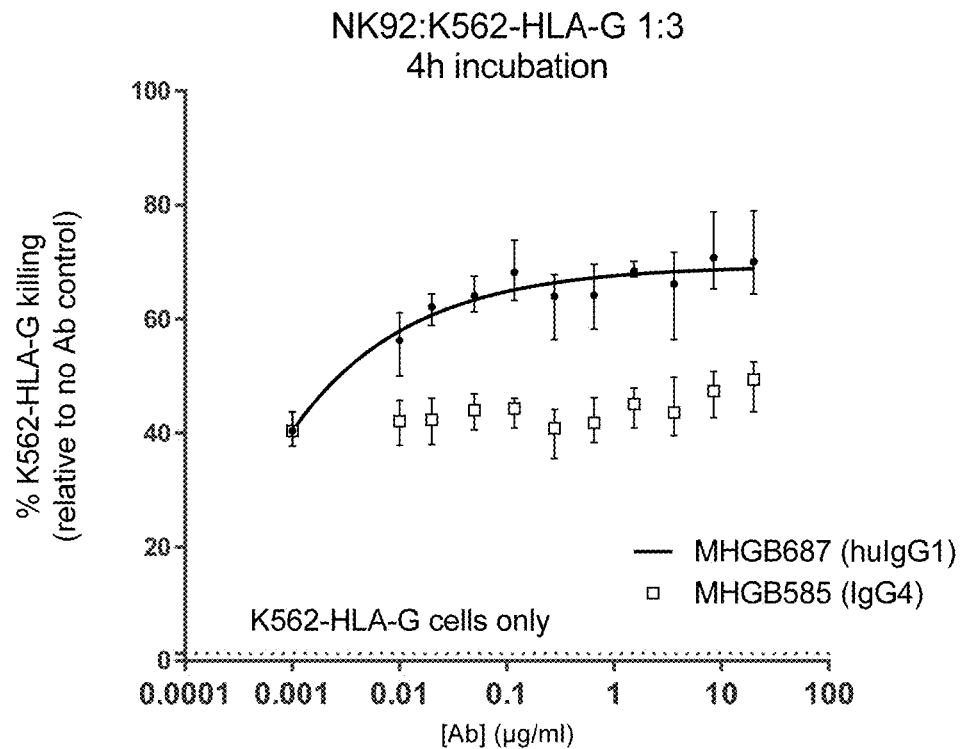
Figure 8A:
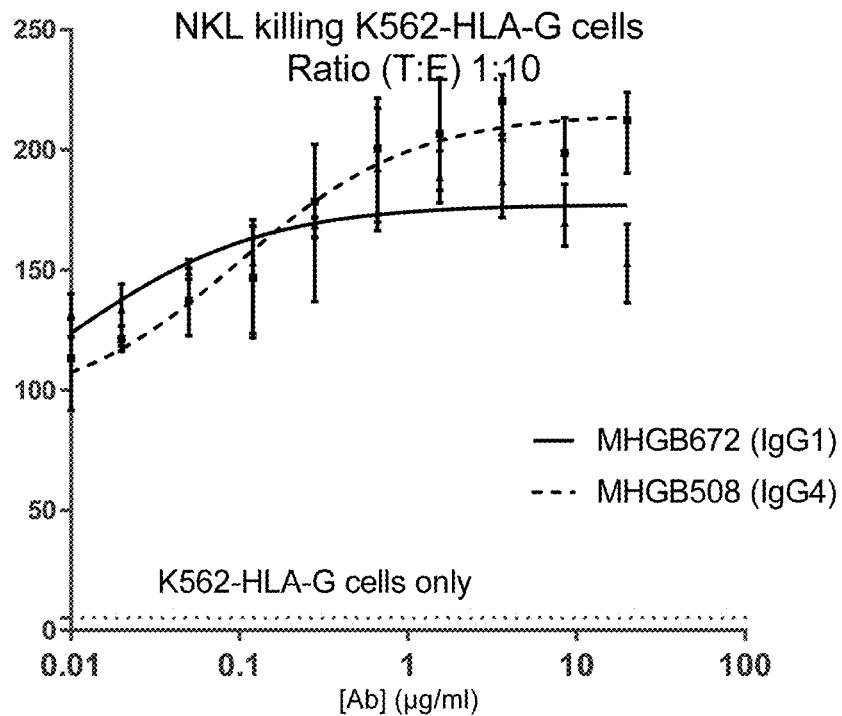
FIGS. 8A-8B show the enhancement of NK cell-mediated cytotoxicity of K562-HLA-G cells by the MHGB672-derived variable region engineered on either IgG1 (MHGB672) or IgG4 (MHGB508).
Figure 8B:
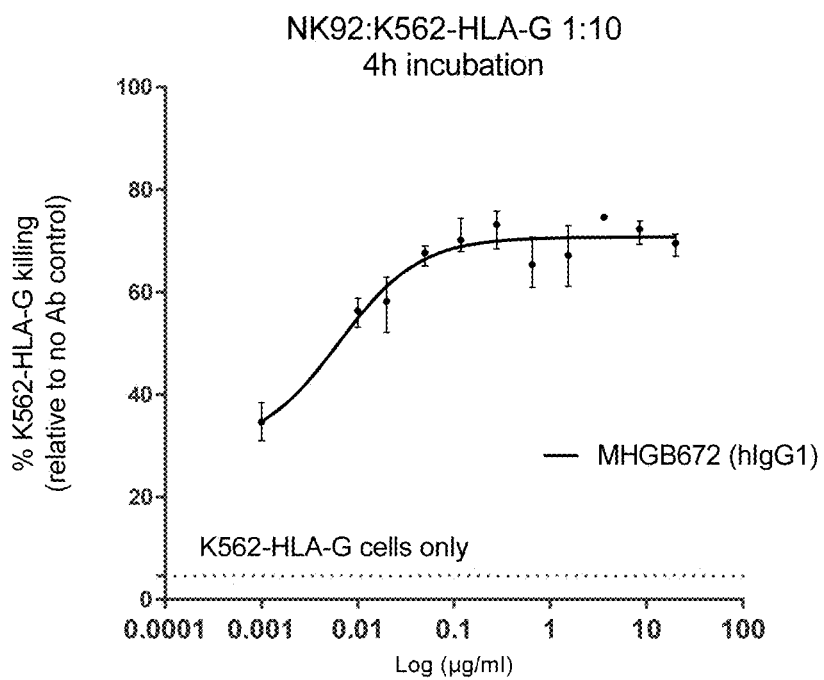

We then asked whether this inhibition of ligand binding was due to direct competition with ILT2/4 for the same binding site on HLA-G. To address this hypothesis, we used hydrogen-deuterium exchange-based LC-MS (described in Example 9) to identify the epitopes on HLA-G for either ILT-2, ILT-4, MHGB732, or MHGB738 (FIG. 2). Binding of both MHGB732 and MHGB738 Abs strongly protected the same peptide in the α3 domain (amino acid residues 191-198 of the mature protein, sequence HHPVFDYE (SEQ ID NO: 485)), resulting in average change in deuteration levels >30%. This peptide was also protected in the presence of ILT2 and to a lesser extent in the presence of ILT4. Both MHGB732 and MHGB738 antibodies also significantly protected (average change in deuteration levels 10%-30%) a second epitope comprised of residues 249-251 of the mature protein, sequence VPS. The epitopes were mapped onto the crystal structure of HLA-G (PDB ID 1YDP)[6], which showed that the epitope for the MHGB732 and MHGB738 Abs and for ILT2/4 resided in the membrane-proximal region of the α3 domain.

Example 7. Effect on NK Cell-Based Cytotoxicity

We then asked whether inhibition of the interaction with HLA-G with ILT-2/4 could mediate anti-tumor activity via NK cell-based cytotoxicity. To address this, we cloned each variable region onto either an IgG1 or a silent IgG4-PAA constant region which lacks effector function. We then tested the ability of each antibody to mediate cytotoxicity of K562-HLA-G cells mediated by NK cells which either express Fc receptors (NK-92) or which lack Fc receptors (NKL). Briefly, K562 cells overexpressing HLA-G cells were labeled with Carboxyfluorescein succinimidyl ester (CFSE) which served as a cell proliferation dye. Antibodies were diluted into a 96-well plate according to the dilutions in FIG. 3A-8B. K562-HLA-G cells were added to each well of antibody and incubated for 1 hr at 4° C. NKL cells were added at approximately 100,000 cells/well, and the mixture was incubated in the presence of IL2 and NKp46 (to activate NKL cells) overnight (NKL cells) or 4 hr (NK-92 cells) at 4° C. Cells were washed by centrifugation and resuspended in buffer with live/dead stain. The mixture was resuspended in 130 µL of staining buffer and analyzed by flow cytometry using a FACS Fortessa cytometer. Antibodies which could mediate cytotoxicity in the absence of NK receptors were thought to mediate this interaction via blocking the immune checkpoint interaction between HLA-G and ILT-2/4 (FIG. 3A-8B). We found that all antibodies which could block ILT2 (all Abs except MHGB687) could enhance NKL cell-mediated cytotoxicity against K562-HLA-G cells in a 24 hr assay (FIGS. 3A, 4A, 5A, 6A, 7A, 8A) whereas only IgG1-based antibodies could enhance Fc-receptor mediated cytotoxicity. This suggested that ligand blocking could serve as an important anti-tumor mechanism, even in the absence of Fc receptor mediated effector function.

Example 8. Effector Functions of mAbs

Figure 9:
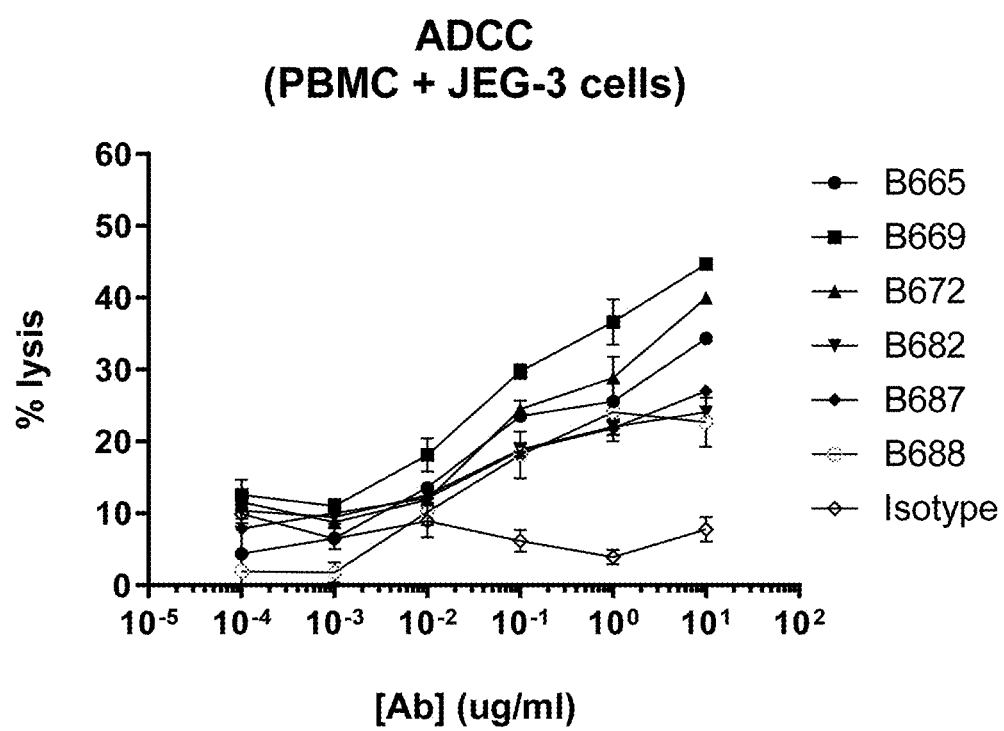
FIG. 9 shows ADCC activity against JEG-3 cells, mediated by the select antibodies MHGB665 ("B665"), MHGB669 ("B669"), MHGB672 ("B672"), MHGB682 ("B682"), MHGB687 ("B687"), and MHGB688 ("B688").

We tested the ability of antibodies to further mediate tumor cell killing via antibody-dependent cellular cytotoxicity (ADCC) against the choriocarcinoma cell line JEG-3 (ATCC HTB-36) which endogenously expresses HLA-G (FIG. 9). Antibodies were added to JEG-3 cells labeled with BATDA dye (Perkin Elmer cat. #C136-100) which can unidirectionally penetrate into the cells. Upon cell lysis, the dye is released into the solution containing Europium which reacts with the dye to form a fluorescent chelate, whose fluorescence signal can be measured. PBMCs cultured overnight were added at an E:T ratio of 50:1 to JEG-3 cells at 5,000 cells/well and the mixture was incubated for 4 hr at 37 C. The cell mixture was added at 1:10 into Europium solution, incubated for 15 min at room temperature and fluorescence at 610 nm was monitored to determine signal. The fluorescence signal for 100% killing was determined using a well containing BADTA-labeled target cells mixed with Triton-X 100 detergent.

Since the anti-HLA-G Abs could display ADCC in vitro, we asked whether this activity could be enhanced. Several studies showed that antibodies having less than 10% terminal fucosylated Fc display enhanced effector function due to higher affinity binding to Fc receptors[7]. Thus, we generated MHGB732 and MHGB738 in a low fucose CHO host to produce an antibody with <10% terminal fucose (MHGB738.CLF) (Table 24, FIG. 10A-D). As a negative control, we generated a version of MHGB738 with an Fc region that could not bind Fc receptors, and this protein was called MHGB745.

Figure 10A:
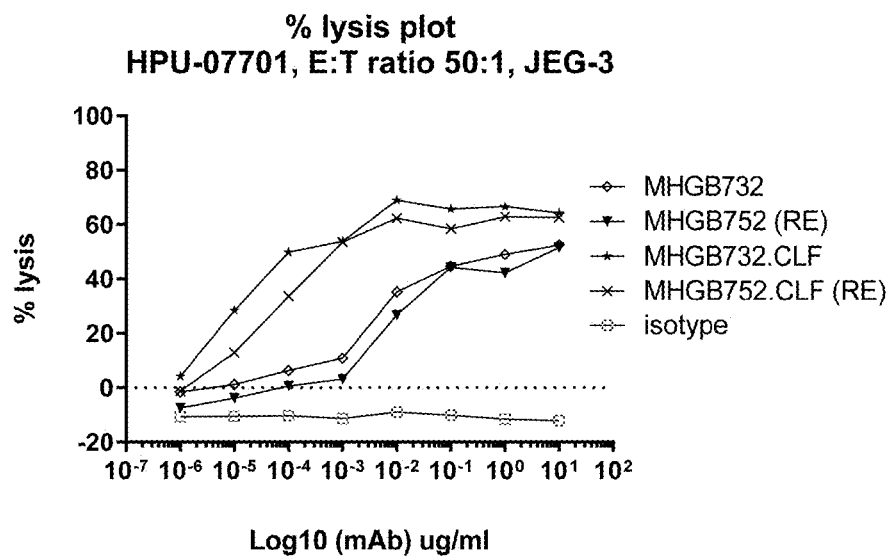
FIGS. 10A-10B show ADCC activity of the select antibodies.
Figure 10B:
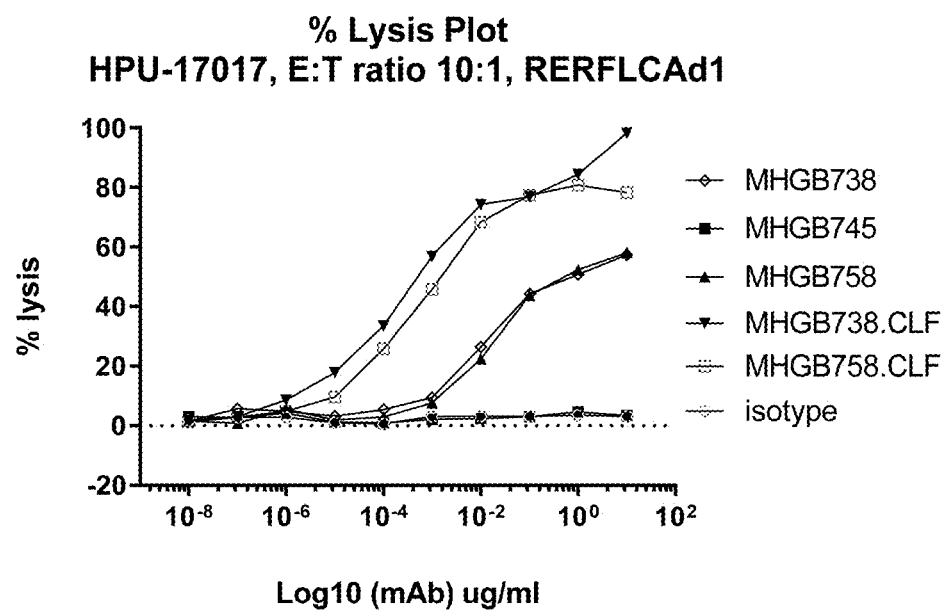

The normal fucose and low fucose antibodies were tested for their abilities to induce NK cell-based ADCC against either JEG-3 cells (FIG. 10A) or against RERF-LC-Ad-1 cells (human lung adenocarcinoma cell line, JCRB1020) (FIG. 10B). Low fucose antibodies were generated by expression of the constructs encoding the heavy chain and light chain in CHO cells which natively express the fucosyltransferase enzyme at low levels, leading to production of antibodies have less than 10% core fucose. The ratio of effector cells to target cells is shown in the graph. The assay was performed in the same way as the ADCC assay described above. Both MHGB745 and the isotype control did not induce ADCC in the assay. The two IgG1 Abs, MHGB732 and MHGB738 could induce ADCC while the same antibodies having low fucose Fc regions displayed ~10-fold enhanced ADCC activity. This showed that ADCC enhancement could be obtained by use of a low fucose antibody.

Figure 10C:
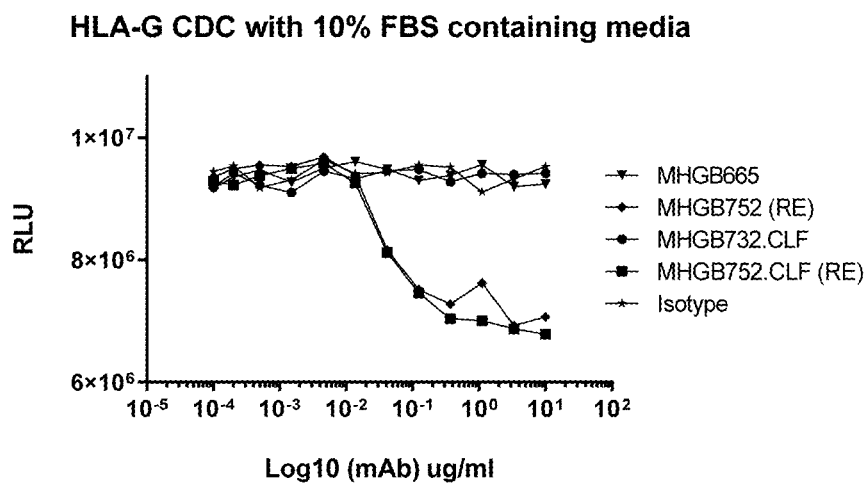
FIGS. 10C-10D show CDC activity of the select antibodies.
Figure 10D:
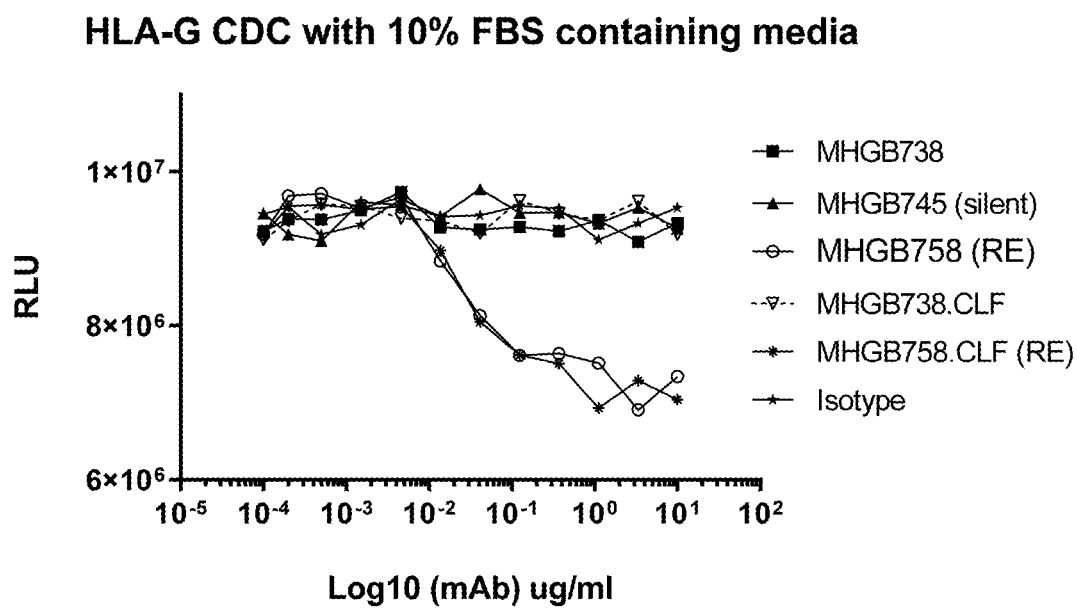

We next tested the abilities of the antibodies to mediate complement-dependent cytotoxicity (CDC) (FIGS. 10C and 10D). Briefly, assays were run in 10% FBS containing DMEM (JEG-3) or RPMI (RERF-LC-Ad-1). Antibodies were added to target cells and incubated for 30 minutes at 37° C. After incubation, 15-20% (stock concentration) of rabbit complement (Cedarlane cat. #CL3441-S) and heat inactivated complement was added to the wells respectively in a volume of 25 µl/well. The mixture was incubated for 4-12 hours at 37° C. Target cell lysis was detected by addition of 100 µl of CellTitre-Glo (Promega cat. # G9242) reagent followed by incubation for 10 minutes at room temperature. Luminescence was monitored using a Tecan Microplate reader SPARK®. The two IgG1 antibodies, MHGB732 and MHGB738 did not mediate CDC. Since the IgG1 Abs could not mediate CDC, we cloned the v-regions into an IgG1 Fc harboring the K248E, T437R (RE) mutations which were shown to specifically enhance CDC activity[8]. These Abs, having the identical v-regions as their IgG1 counterparts, could mediate CDC activity. We asked whether the RE Fc variant would impact ADCC activity enhancement in the low fucose Abs and whether the low fucose Fc would impact CDC activity of the RE Fc variants. The RE Abs produced in a low fucose host (having <10% fucosylated Fc), MHGB752 and MHGB758 had identical ADCC activity to the low fucose IgG1 Abs MHGB732 and MHGB738 (FIGS. 10A and 10B). Analogously, the RE Abs produced in a low fucose host had identical CDC activity to the RE Abs produced in a normal fucose host (FIGS. 10C and 10D).

TABLE 24

Description of variants of MHGB738 having modified constant regions.

| Protein Name | Description |
| --- | --- |
| MHGB732 | IgG1 |
| MHGB738 | IgG1 |
| MHGB745 | L234A, L235A, D265S |
| MHGB752 | IgG1, K248E, T437R (RE) |
| MHGB758 | IgG1, K248E, T437R (RE) |
| MHGB732.CLF | IgG1, low fucose |
| MHGB738.CLF | IgG1, low fucose |

TABLE 24-continued

Description of variants of MHGB738 having modified constant regions.

| Protein Name | Description |
| --- | --- |
| MHGB758.CLF | IgG1, K248E, T437R (RE), low fucose |
| MHGB758.CLF | IgG1, K248E, T437R (RE), low fucose |

Example 9: Generation of CD3 Antibodies

Immunization

The generation of anti-CD3 antibody CD3B376 and CD3B450 have been describe in US20200048349. The humanized anti-CD3 v-region featured in CD3B219 was derived from the commercially available antibody SP34-2 (BD Biosciences 551916).

Additional anti-CD3 antibodies were generated using Ablexis transgenic mouse platform, as described below. Ablexis mice were immunized with TRCW5 (SEQ ID NO: 336), including 13 Kappa mice and 12 Lambda mice. TRCW5 is comprised of the extracellular region of CD3δ fused by a 26 amino acid linker to the extracellular region of CD3ε as reported in Kim et al, JMB (2000) 302(4): 899-916. This polypeptide had at its C-terminus a human IgG1 Fc domain with a C-terminal Avi-tag used for site-specific biotinylation (Fairhead & Howarth, Methods Mol Biol (2015); 1266: 171-184).

```
TRCW5
                                        (SEQ ID NO: 336)
FKIPIEELEDRVFVNCNTSITWVEGTVGTLLSDITRLDLGKRILDPRGI

YRCNGTDIYKDKESTVQVHYRMGSADDAKKDAAKKDDAKKDDAKKDGSD

GNEEMGGITQTPYKVSISGTTVILTCPQYPGSEILWQHNDKNIGGDEDD

KNIGSDEDHLSLKEFSELEQSGYYVCYPRGSKPEDANFYLYLRARVSPP

SPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNK

ALPAPIEKTISKAKGQPREPQVYTLPPSRDELTKNQVSLTCLVKGFYPS

DIAVEWESNGQPENNYKTTPPVLDSDGSFFLYSKLTVDKSRWQQGNVFS

CSVMHEALHNHYTQKSLSLSPGKGGGLNDIFEAQKIEWHE
```

Mice were immunized twice weekly for the duration of 7 weeks. On day 42, mice were boosted for hybridoma fusion by administration of 50 µg TRCW5 and 50 µg CD40 mAb spread over 8 sites, including 6 subcoutaneous and 2 intradermal injections. For a final boost, mice received 20 µL injections of Jurkat cells, a T cell line which endogenously expresses the T cell receptor complex, including CD3ε (Schneider et al (1977) Int. J. Cancer, 19 (5): 621-6), at 4.74×107 cells/mL.

Lymph nodes and spleens were extracted from mice and fusions performed by cohorts. Lymph node cells were counted and combined in a 1:1 ratio with FO myeloma cells (ATCC (CRL-1646)) and incubated for 10 d at 37° C. prior to antibody screening. Supernatants from hybridoma fusion cells were then assayed by ELISA for binding to TRCW5 using TRCW5 either non-specifically immobilized on the plate (ELISA, Thermo cat. #34022) or by streptavidin conjugation to biotinylated-TRCW5 (SPARCL ELISA, Lumigen), according to manufacturers' instructions. ELISA assays were performed by coating plates with 0.5 ug/mL TRCW5 and 0.5 ug/mL HVEM-Fc (R&D cat. #365-HV)

overnight @ 4° C. Plates were blocked by addition of 0.4% (w/v) bovine serum albumin (BSA) in phosphate-buffered saline (PBS) overnight @ 4° C. Plates were washed with 1×PBS supplemented with 0.02% (v/v) Tween 20. To each well, 50 uL of hybridoma supernatant was applied and incubated for 1 hr at room temperature. Bound antibody was detected by addition of goat anti-mouse IgG Fc conjugated to horseradish peroxidase (Jackson cat. #115-036-071) diluted 1:10,000 in blocking buffer followed by incubation for 30 min at room temperature. 3,3,5, 5-tetramethylbenzidine (TMB) substrate buffer (Thermo cat. #34022) was added at 25 uL/well and incubated for 10 min in the dark. Reactions were stopped by addition of 25 uL/well of 4 M H2SO4. Luminescence was read at 450 nm using BioTek® Epoch2 Microplate Reader. Hits were selected having signal at least 3-fold higher than background.

Figure 11A:
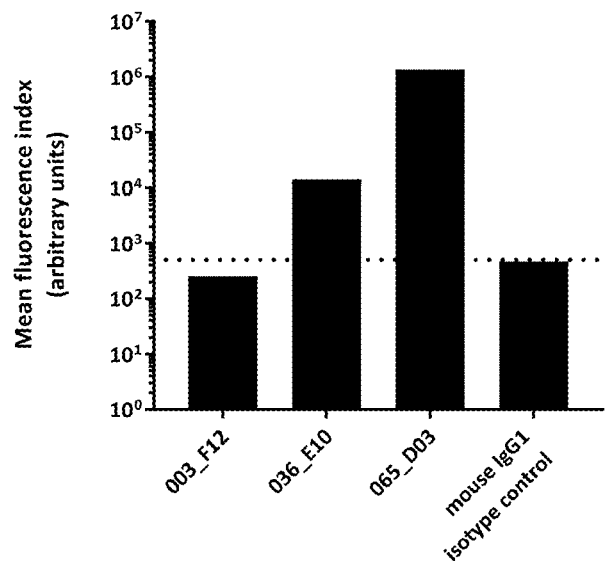
FIGS. 11A-11B show binding of hybridoma supernatants to primary human T cells. Clone UCHT1 was used as a positive control (11B); mouse IgG1 isotype (mIgG1) was used as a negative control.
Figure 11B:
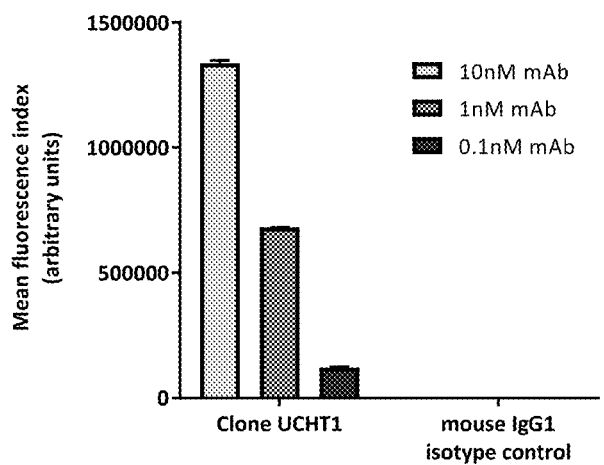

The two assay formats resulted in 426 hits (264 hits from ELISA, 194 from SPARCL ELISA, 70 hits were identified in both assays). Of these 426 initial hits, 49 ELISA and 32 SPARCL ELISA hits were confirmed. The hyriboma fusions corresponding to the positive binders were refed and tested for their abilities to bind Jurkat cells, using flow cytometry. The results suggested that three antibodies, including clone 003_F12, clone 036_E10 and clone 065_D03, showed significant binding to Jurkat cells, endogenously expressing CD3, based on mean fluorescence index (MFI, see Table 25). While clones 003_F12 and 036_E10 (from human kappa mice) were confirmed positive for human kappa light chain by ELISA, clone 065_D03 (from human lambda mouse) was negative for human lambda. The variable genes of these three clones were then sequenced.

human and cyno pan T cells were resuspended at 1×10$^6$ cells/mL in flow staining buffer and cells were plated at 50,000 cells/well. To each well, 50 uL of hybridoma supernatant were added and the mixture was incubated on ice for 30 min. After incubation, 200 μL of staining buffer was added and cells were pelleted by centrifugation at 300×G for 5 min. Anti-mouse IgG conjugated to Alexa-647 was added at 2 μg/mL in staining buffer in 50 μL total volume and incubated for 30 min on ice. 150 μL of staining buffer was added and cells were pelleted by centrifugation at 300×G for 5 min. Cells were resuspended in 30 μL of running buffer containing 1:1,000-diluted Sytox green dead cell stain and run on iQue Screener. Cells were gated on FCS vs SCS to eliminate debris. Singlets were gated on SCS-A vs SCS-H, and from singlet population, live cells were chosen using BL1 channel for low-negative with Sytox green. CD3 binding was assessed by comparing test articles to negative control by RL1 (Alexa-647) geomeans. In this assay, clone 065_D03 showed the highest cell binding signal (FIG. 11A-11B).

The variable region of the Clone 065_D03 was then cloned into an IgG1 backbone, resulting in the antibody termed CD3B815 (sequences are shown in Table 26). CD3B815 was screened again for binding to Jurkat cells and showed positive binding to Jurkat cells.

TABLE 26

CD3B815 amino acid sequences.

| Protein | SEQ ID NO: | Amino acid sequences |
|---|---|---|
| CD3B815 Heavy Chain | 337 | EVQLVESGGGLVKPGGSLRLSCAASGFTFSRYNMNWVRQAPGKGL EWVSSISTSSNYIYYADSVKGRFTFSRDNAKNSLDLQMSGLRAEDT AIYYCTRGWGPFDYWGQGTLVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKKVEPKSCDKTHTCPPCP APELLGGPSVFLFPPKPKDTLMISRTPEVTCVVVDVSHEDPEVKFN WYVDGVEVHNAKTKPREEQYNSTYRVVSVLTVLHQDWLNGKEY KCKVSNKALPAPIEKTISKAKGQPREPQVYTLPPSREEMTKNQVSLT CLVKGFYPSDIAVEWESNGQPENNYKTTPPVLDSDGSFFLYSKLTV DKSRWQQGNVFSCSVMHEALHNHYTQKSLSLSPGK |
| CD3B815 Light Chain | 338 | DILLTQSPGILSVSPGERVSFSCRARQSIGTAIHWYQQRTNGSPRLLI KYASESISGIPSRFSGSGSGTDFTLTINSVESEDIADYYCQQSNSWPY TFGGGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |

TABLE 25

Mean fluorescence index (MFI) for binding of selected clones to Jurkat cells

| Clone ID | MFI (arbitrary units) |
|---|---|
| 003_F12 | 176147 |
| 036_E10 | 43133 |
| 065_D03 | 136269 |
| No Ab | 2075.61 |
| 10 nM UCHT1 | 89214.29 |

Next, these three clones were screened for their abilities to bind primary human and cyno T cells. Briefly, primary Humanization and scFv Formatting of CD3 Binding Domains The light chain (LC) of the v-region of CD3B815 was humanized in scFv format. Briefly, the LC from CD3B815 was grafted onto the human IGHV3-21*04 germline and two positions (Y49K and L78V, according to Kabat) were identified for human to mouse back mutations. This resulted in variants, having either Y49K, L78V, or both Y49K and L78V. The LC from CD3B815 also contained an NS motif which presents a risk for deamidation at positions 92-93. Therefore, several variants generated also contained N92G. These variants and associated mutations are described in Table 27, and the VH and the VL amino acid and nucleic acid sequences are shown in Tables 28 and 29. CDR sequences are shown in Tables 30-32.

TABLE 27

Mutations in humanized csFv variants.

| scFv identification | Description | VL mutations |
|---|---|---|
| CD3W234 | CD3B815-HL-scFV, Contains mouse VL | none |
| CD3W238 | CDR of CD3B815 grafted into IGKV1D-39*01 | none |
| CD3W241 | CDR of CD3B815 grafted into IGKV1D-39*01 | L78V |
| CD3W242 | CDR of CD3B815 grafted into IGKV1D-39*01 | Y49K |
| CD3W243 | CDR of CD3B815 grafted into IGKV1D-39*01 | Y49K, L78V |
| CD3W244 | CDR of CD3B815 grafted into IGKV1D-39*01 | L78V, N92G |
| CD3W245 | CDR of CD3B815 grafted into IGKV1D-39*01 | Y49K, N92G |
| CD3W246 | CDR of CD3B815 grafted into IGKV1D-39*01 | Y49K, L78V, N92G |
| CD3W247 | CDR of CD3B815 grafted into IGKV1D-39*01 | N92G |
| CD3W248 | CD3B815-HL-scFV, Contains mouse VL | N92G |

Table 28 shows the VH and the VL amino acid sequences of selected anti-CD3 antibodies. Table 29 shows the VH and the VL DNA sequences of selected anti-CD3 antibodies. Table 30 shows the Kabat HCDR1, HCDR2 and the HCDR3 amino acid sequences of selected anti-CD3 antibodies. Table 31 shows the Kabat LCDR1, LCDR2 and the LCDR3 amino acid sequences of selected anti-CD3 antibodies. Table 32 shows CDRs and variable domains of the anti-CD3 antibodies. FIG. 13 shows the alignment of the VL region of CD3B815, CD3W244, CD3W245, CD3W246, and CD3W247.

TABLE 28

VH and VL amino acid sequences of selected anti-CD3 antibodies.

| mAb | VH name | VH sequence | VH SEQ ID NO: | name | VL sequence | VL SEQ ID NO: |
|---|---|---|---|---|---|---|
| CD3B815 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 | CD3L372 | DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK | 340 |
| CD3W244 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 | CD3L394 | DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK | 341 |
| CD3W245 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 | CD3L395 | DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK | 342 |
| CD3W246 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 | CD3L396 | DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK | 343 |

TABLE 28-continued

VH and VL amino acid sequences of selected anti-CD3 antibodies.

| mAb | VH name | VH sequence | VH SEQ ID NO: | VL name | VL sequence | VL SEQ ID NO: |
|---|---|---|---|---|---|---|
| CD3W247 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 | CD3L397 | DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK | 344 |
| CD3W248 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 | CD3L398 | DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK | 345 |
| CD3B376 | CD3H219 | QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS | 346 | CD3L150 | QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL | 347 |
| CD3B450 | CD3H231 | QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSS | 348 | CD3L197 | QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVL | 349 |

TABLE 29

VH and VL nucleic acid sequences of the humanized csFv variants.

| Binding domain name | VH nucleic acid Sequence | VH SEQ ID NO: | VL nucleic acid sequence | VL SEQ ID NO: |
|---|---|---|---|---|
| CD3B815 | GAGGTGCAACTGGTGGAGTCTGGGGGAGGCCTGGTCAAGCCTGGGGGGTCCCTGAGACTCTCCTGTGCAGCCTCTGGATTCACCTTCAGTAGATATAACATGAACTGGGTCCGCCAGGCTCCAGGGAAGGGGCTGGAGTGGGTCTCATCCATTAGTACTAGTAGTAATTACATATACTACGCAGACTCAGTGAAGGGCCGATTCACCTTCTCCAGAGACAACGCCAAGAACTCACTGGATCTGCAAATGAGCGGCCTGAGAGCCG | 350 | GATATACTTCTTACCCAGAGTCCCGGCATCCTCTCCGTTAGCCCTGGGGAGAGAGTCTCATTCTCATGCCAGCCAGACAGTCAATTGGTACCGCAATACACTGGTATCAACAGCGGACCAATGGTTCTCCCCGACTTCTGATAAAGTACGCATCAGAATCAATTAGTGGAATACCATCAAGATTTAGTGGCTCAGGGAGTGGAACCGATTTTACTCTGACCATCAACTCAGTGGAATCTGAGGACATTGCCGACTACTACTGTCAACAAAGCAATAGTTGGCCATATACCTTCG | 351 |

TABLE 29-continued

VH and VL nucleic acid sequences of the humanized csFv variants.

| Binding domain name | VH nucleic acid Sequence | VH SEQ ID NO: | VL nucleic acid sequence | VL SEQ ID NO: |
|---|---|---|---|---|
| | AGGACACGGCTATTTAT TACTGTACGAGAGGCTG GGGGCCTTTTGACTACT GGGGCCAGGGAACCCT GGTCACCGTCTCCTCA | | GAGGCGGAACTAAATTGG AGATAAAA | |
| CD3W244 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 350 | GACATCCAGATGACACAG TCACCTTCTAGTTTGTCTG CTTCTGTAGGCGACCGTGT AACTATCACCTGTCGAGCC CGTCAAAGTATTGGTACTG CCATTCACTGGTACCAACA AAAACCTGGCAAAGCTCC AAAACTCTTGATCTACTAT GCCTCCGAAAGCATATCA GGGGTCCCAAGCAGATTC TCAGGCAGTGGCAGTGGC ACTGACTTCACTCTCACCA TTTCTAGCGTGCAACCAGA GGACTTCGCCACTTATTAC TGCCAACAGTCAGGGAGC TGGCCCTACACCTTCGGCC AAGGTACAAAACTGGAGA TCAAA | 352 |
| CD3W245 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 350 | GACATACAAATGACACAA TCACCCTCTTCTCTTTCTG CAAGCGTTGGCGACCGTG TCACTATCACTTGTCGAGC CCGCCAGTCCATAGGTACT GCCATTCACTGGTATCAAC AGAAGCCTGGCAAGGCTC CCAAACTCCTGATTAAGTA TGCCAGCGAGAGCATTTC CGGCGTACCTTCAAGATTT TCCGGCTCCGGTAGTGGG ACAGATTTCACTCTCACTA TATCTAGCCTCCAACCAGA AGATTTCGCCACTTACTAC TGTCAACAATCAGGTTCAT GGCCTTACACTTTCGGCCA GGGGACAAAATTGGAGAT CAAG | 353 |
| CD3W246 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 350 | GACATCCAAATGACTCAA TCACCTAGCAGCCTCTCCG CCTCCGTTGGAGATAGAG TGACAATAACTTGCCGAG CCCGGCAAAGTATCGGAA CTGCTATTCACTGGTATCA ACAAAAACCTGGAAAGGC ACCTAAGCTCTTGATTAAA TACGCTTCTGAGTCCATCT CCGGCGTGCCTTCACGATT CAGCGGCAGCGGTAGTGG TACTGACTTTACCCTCACT ATTAGTTCTGTTCAGCCAG AGGACTTCGCAACTTATTA CTGCCAACAGAGTGGTTC CTGGCCATACACTTTTGGC CAGGGGACTAAATTGGAA ATCAAA | 354 |
| CD3W247 | GAGGTGCAACTGGTGG AGTCTGGGGGAGGCCT | 350 | GACATCCAAATGACTCAA AGCCCCTCTAGTTTGAGTG | 355 |

TABLE 29-continued

VH and VL nucleic acid sequences of the humanized csFv variants.

| Binding domain name | VH nucleic acid Sequence | VH SEQ ID NO: | VL nucleic acid sequence | VL SEQ ID NO: |
|---|---|---|---|---|
| | GGTCAAGCCTGGGGGG<br>TCCCTGAGACTCTCCTG<br>TGCAGCCTCTGGATTCA<br>CCTTCAGTAGATATAAC<br>ATGAACTGGGTCCGCCA<br>GGCTCCAGGGAAGGGG<br>CTGGAGTGGGTCTCATC<br>CATTAGTACTAGTAGTA<br>ATTACATATACTACGCA<br>GACTCAGTGAAGGGCC<br>GATTCACCTTCTCCAGA<br>GACAACGCCAAGAACT<br>CACTGGATCTGCAAATG<br>AGCGGCCTGAGAGCCG<br>AGGACACGGCTATTTAT<br>TACTGTACGAGAGGCTG<br>GGGGCCTTTTGACTACT<br>GGGGCCAGGGAACCCT<br>GGTCACCGTCTCCTCA | | CATCTGTAGGTGACCGGG<br>TAACAATCACCTGCCGTGC<br>CCGGCAAAGTATAGGTAC<br>TGCAATCCACTGGTACCA<br>GCAAAAACCCGGCAAAGC<br>ACCAAAGCTGCTCATATA<br>CTATGCTAGTGAGAGCATT<br>TCTGGCGTTCCTAGTCGAT<br>TTTCTGGATCAGGGAGTG<br>GAACTGATTTTACACTGAC<br>AATCAGCAGCCTCCAACC<br>CGAAGACTTCGCCACCTA<br>CTATTGTCAGCAGTCTGGG<br>TCCTGGCCTTACACATTCG<br>GTCAAGGAACTAAATTGG<br>AGATCAAA | |
| CD3W248 | GAGGTGCAACTGGTGG<br>AGTCTGGGGGAGGCCT<br>GGTCAAGCCTGGGGGG<br>TCCCTGAGACTCTCCTG<br>TGCAGCCTCTGGATTCA<br>CCTTCAGTAGATATAAC<br>ATGAACTGGGTCCGCCA<br>GGCTCCAGGGAAGGGG<br>CTGGAGTGGGTCTCATC<br>CATTAGTACTAGTAGTA<br>ATTACATATACTACGCA<br>GACTCAGTGAAGGGCC<br>GATTCACCTTCTCCAGA<br>GACAACGCCAAGAACT<br>CACTGGATCTGCAAATG<br>AGCGGCCTGAGAGCCG<br>AGGACACGGCTATTTAT<br>TACTGTACGAGAGGCTG<br>GGGGCCTTTTGACTACT<br>GGGGCCAGGGAACCCT<br>GGTCACCGTCTCCTCA | 350 | GACATTTTGCTGACACAG<br>AGCCCTGGTATCCTCTCAG<br>TCAGTCCAGGGGAACGCG<br>TTTCATTTAGCTGCCGTGC<br>TCGACAGAGCATTGGGAC<br>CGCAATCCACTGGTACCA<br>ACAAAGAACTAACGGTTC<br>ACCACGGCTTTTGATTAAG<br>TATGCCTCCGAATCCATCA<br>GTGGCATTCCTAGTCGTTT<br>TTCTGGATCAGGATCAGG<br>CACCGACTTTACTCTCACA<br>ATTAATAGTGTCGAAAGT<br>GAGGACATTGCAGACTAT<br>TATTGTCAGCAATCCGGTT<br>CCTGGCCCTATACTTTTGG<br>TGGTGGTACTAAGTTGGA<br>AATTAAA | 356 |
| CD3B376 | CAGGTGCAGCTGCAGC<br>AGTCTGGCCCTAGACTC<br>GTGCGGCCTTCCCAGAC<br>CCTGTCTCTGACCTGTG<br>CCATCTCCGGCGACTCC<br>GTGTTCAACAACAACGC<br>CGCCTGGTCCTGGATCC<br>GGCAGAGCCCTTCTAGA<br>GGCCTGGAATGGCTGG<br>GCCGGACCTACTACCGG<br>TCCAAGTGGCTGTACGA<br>CTACGCCGTGTCCGTGA<br>AGTCCCGGATCACCGTG<br>AACCCTGACACTCCCG<br>GAACCAGTTCACCCTGC<br>AGCTGAACTCCGTGACC<br>CCTGAGGACACCGCCCT<br>GTACTACTGCGCCAGAG<br>GCTACTCCTCCTCCTTC<br>GACTATTGGGGCCAGG<br>GCACCCTCGTGACCGTG<br>TCCTCT | 357 | AGTCTGCTCTGACCCAGCC<br>TGCCTCCGTGTCTGGCTCT<br>CCCGGCCAGTCCATCACC<br>ATCAGCTGTACCGGCACCT<br>CCTCCAACATCGGCACCTA<br>CAAGTTCGTGTCCTGGTAT<br>CAGCAGCACCCCGACAAG<br>GCCCCCAAAGTGCTGCTGT<br>ACGAGGTGTCCAAGCGGC<br>CCTCTGGCGTGTCCTCCAG<br>ATTCTCCGGCTCCAAGTCT<br>GGCAACACCGCCTCCCTG<br>ACCATCAGCGGACTGCAG<br>GCTGAGGACCAGGCCGAC<br>TACCACTGTGTGTCCTACG<br>CTGGCTCTGGCACCCTGCT<br>GTTTGGCGGAGGCACCAA<br>GCTGACCGTGCTG | 358 |
| CD3B450 | CAAGTGCAACTCCAACA<br>AAGCGGCCCAGGGCTG<br>GTAAAGCCTTCACAGAC<br>CCTCTCACTTACTTGCG<br>CAATATCTGGGGACTCC<br>GTGTTTAATAACAATGC<br>TGCATGGAGCTGGATTC<br>GCCAGAGCCCAAGTCG<br>CGGGCTCGAGTGGCTTG | 359 | CAGTCTGCTCTGACCCAGC<br>CTGCCTCCGTGTCTGGCTC<br>TCCCGGCCAGTCCATCACC<br>ATCAGCTGTACCGGCACCT<br>CCTCCAACATCGGCACCTA<br>CAAGTTCGTGTCCTGGTAT<br>CAGCAGCACCCCGGCAAG<br>GCCCCCAAAGTGATGATC<br>TACGAGGTGTCCAAGCGG | 360 |

TABLE 29-continued

VH and VL nucleic acid sequences of the humanized csFv variants.

| Binding domain name | VH nucleic acid Sequence | VH SEQ ID NO: | VL nucleic acid sequence | VL SEQ ID NO: |
|---|---|---|---|---|
| | GTCGAACCTATTACCGC TCCAAGTGGCTCTATGA CTACGCAGTAAGCGTCA AATCACGGATAACAATC AACCCTGACACATCCAA GAATCAGTTTAGTCTGC AACTCAACTCAGTCACC CCTGAGGATACCGCAGT GTATTATTGTGCCAGAG GGTACAGCTCTTCCTTT GATTACTGGGGCCAAG GTACACTGGTAACAGTA TCAAGC | | CCCTCCGGCGTGTCCAACA GATTCTCCGGCTCCAAGTC CGGCAACACCGCCTCCCT GACAATCAGCGGACTGCA GGCCGAGGACGAGGCCGA CTACTACTGTGTGTCCTAC GCCGGCTCTGGCACCCTGC TGTTTGGCGGCGGAACAA AGCTGACCGTGCTG | |

TABLE 30

Kabat HCDR1, HCDR2 and HCDR3 amino acid sequences of selected anti-CD3 antibodies.

| mAb | HCDR1 | SEQ ID NO: | HCDR2 | SEQ ID NO: | HCDR3 | SEQ ID NO: |
|---|---|---|---|---|---|---|
| CD3B815 | RYNMN | 361 | SISTSSNYIYYADSVKG | 362 | GWGPFDY | 363 |
| CD3W244 | RYNMN | 361 | SISTSSNYIYYADSVKG | 362 | GWGPFDY | 363 |
| CD3W245 | RYNMN | 361 | SISTSSNYIYYADSVKG | 362 | GWGPFDY | 363 |
| CD3W246 | RYNMN | 361 | SISTSSNYIYYADSVKG | 362 | GWGPFDY | 363 |
| CD3W247 | RYNMN | 361 | SISTSSNYIYYADSVKG | 362 | GWGPFDY | 363 |
| CD3W248 | RYNMN | 361 | SISTSSNYIYYADSVKG | 362 | GWGPFDY | 363 |
| CD3B376 | NNNAAWS | 364 | RTYYRSKWLYDYAVSVKS | 365 | GYSSSFDY | 366 |
| CD3B450 | NNNAAWS | 364 | RTYYRSKWLYDYAVSVKS | 365 | GYSSSFDY | 366 |

TABLE 31

Kabat LCDR1, LCDR2 and LCDR3 amino acid sequences of selected anti-CD3 antibodies.

| mAb | LCDR1 | SEQ ID NO: | LCDR2 | SEQ ID NO: | LCDR3 | SEQ ID NO: |
|---|---|---|---|---|---|---|
| CD3B815 | RARQSIGTAIH | 367 | YASESIS | 368 | QQSNSWPYT | 369 |
| CD3W244 | RARQSIGTAIH | 367 | YASESIS | 368 | QQSGSWPYT | 370 |
| CD3W245 | RARQSIGTAIH | 367 | YASESIS | 368 | QQSGSWPYT | 370 |
| CD3W246 | RARQSIGTAIH | 367 | YASESIS | 368 | QQSGSWPYT | 370 |
| CD3W247 | RARQSIGTAIH | 367 | YASESIS | 368 | QQSGSWPYT | 370 |
| CD3W248 | RARQSIGTAIH | 367 | YASESIS | 368 | QQSGSWPYT | 370 |
| CD3B376 | TGTSSNIGTYKFVS | 371 | EVSKRPS | 372 | VSYAGSGTLL | 373 |
| CD3B450 | TGTSSNIGTYKFVS | 371 | EVSKRPS | 372 | VSYAGSGTLL | 373 |

TABLE 32

HCDR1, HCDR2, HCD3, LCD1, LCD2, LCD3, VH and VL of anti-CD3 antibodies

| Antibody | Region | Amino Acid sequence | SEQ ID NO: |
|---|---|---|---|
| CD3B815 | HCDR1 | RYNMN | 361 |
| | HCDR2 | SISTSSNYIYYADSVKG | 362 |
| | HCDR3 | GWGPFDY | 363 |
| | LCDR1 | RARQSIGTAIH | 367 |
| | LCDR2 | YASESIS | 368 |
| | LCDR3 | QQSNSWPYT | 369 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 339 |
| | VL (CD3L372) | DILLTQSPGILSVSPGERVSFSCRARQSIGTAIHWYQQR TNGSPRLLIKYASESISGIPSRFSGSGSGTDFTLTINSVES EDIADYYCQQSNSWPYTFGGGTKLEIK | 340 |
| CD3W244 | HCDR1 | RYNMN | 361 |
| | HCDR2 | SISTSSNYIYYADSVKG | 362 |
| | HCDR3 | GWGPFDY | 363 |
| | LCDR1 | RARQSIGTAIH | 367 |
| | LCDR2 | YASESIS | 368 |
| | LCDR3 | QQSGSWPYT | 370 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 339 |
| | VL (CD3L394) | DIQMTQSPSSLSASVGDRVTITCRARQSIGTAIHWYQQ KPGKAPKLLIYYASESISGVPSRFSGSGSGTDFTLTISSV QPEDFATYYCQQSGSWPYTFGQGTKLEIK | 341 |
| CD3BW245 | HCDR1 | RYNMN | 361 |
| | HCDR2 | SISTSSNYIYYADSVKG | 362 |
| | HCDR3 | GWGPFDY | 363 |
| | LCDR1 | RARQSIGTAIH | 367 |
| | LCDR2 | YASESIS | 368 |
| | LCDR3 | QQSGSWPYT | 370 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 339 |
| | VL (CD3L395) | DIQMTQSPSSLSASVGDRVTITCRARQSIGTAIHWYQQ KPGKAPKLLIKYASESISGVPSRFSGSGSGTDFTLTISSL QPEDFATYYCQQSGSWPYTFGQGTKLEIK | 342 |
| CD3BW246 | HCDR1 | RYNMN | 361 |
| | HCDR2 | SISTSSNYIYYADSVKG | 362 |
| | HCDR3 | GWGPFDY | 363 |
| | LCDR1 | RARQSIGTAIH | 367 |
| | LCDR2 | YASESIS | 368 |
| | LCDR3 | QQSGSWPYT | 370 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 339 |
| | VL (CD3L396) | DIQMTQSPSSLSASVGDRVTITCRARQSIGTAIHWYQQ KPGKAPKLLIKYASESISGVPSRFSGSGSGTDFTLTISSV QPEDFATYYCQQSGSWPYTFGQGTKLEIK | 343 |
| CD3BW247 | HCDR1 | RYNMN | 361 |
| | HCDR2 | SISTSSNYIYYADSVKG | 362 |
| | HCDR3 | GWGPFDY | 363 |
| | LCDR1 | RARQSIGTAIH | 367 |
| | LCDR2 | YASESIS | 368 |
| | LCDR3 | QQSGSWPYT | 370 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 339 |
| | VL (CD3L397) | DIQMTQSPSSLSASVGDRVTITCRARQSIGTAIHWYQQ KPGKAPKLLIYYASESISGVPSRFSGSGSGTDFTLTISSL QPEDFATYYCQQSGSWPYTFGQGTKLEIK | 344 |

TABLE 32-continued

HCDR1, HCDR2, HCD3, LCD1, LCD2, LCD3, VH and VL of anti-CD3 antibodies

| Antibody | Region | Amino Acid sequence | SEQ ID NO: |
|---|---|---|---|
| CD3BW248 | HCDR1 | RYNMN | 361 |
|  | HCDR2 | SISTSSNYIYYADSVKG | 362 |
|  | HCD3 | GWGPFDY | 363 |
|  | LCD1 | RARQSIGTAIH | 367 |
|  | LCD2 | YASESIS | 368 |
|  | LCD3 | QQSGSWPYT | 370 |
|  | VH (CD3H488) | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 339 |
|  | VL (CD3L398) | DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK | 345 |
| CD3B376 | HCDR1 | NNNAAWS | 364 |
|  | HCDR2 | RTYYRSKWLYDYAVSVKS | 365 |
|  | HCDR3 | GYSSSFDY | 366 |
|  | LCDR1 | TGTSSNIGTYKFVS | 371 |
|  | LCDR2 | EVSKRPS | 372 |
|  | LCDR3 | VSYAGSGTLL | 373 |
|  | VH (CD3H219) | QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS | 346 |
|  | VL (CD3L150) | QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL | 347 |
| CD3B450 | HCDR1 | NNNAAWS | 364 |
|  | HCDR2 | RTYYRSKWLYDYAVSVKS | 365 |
|  | HCDR3 | GYSSSFDY | 366 |
|  | LCDR1 | TGTSSNIGTYKFVS | 371 |
|  | LCDR2 | EVSKRPS | 372 |
|  | LCDR3 | VSYAGSGTLL | 373 |
|  | VH (CD3H231) | QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSS | 348 |
|  | VL (CD3L197) | QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVL | 349 |

Consensus Sequence

FIG. 13 shows the alignment of the VL regions of CD3B815, CD3W244, CD3W245, CD3W246, and CD3W247. A consensus amino acid sequence of SEQ ID NO: 374 was determined for the VL region, HCDR and LCDR residues are underlined.

SEQ ID NO: 374
DIQX$_1$TQSPX$_2$X$_3$LSX$_4$SX$_5$GX$_6$RVX$_7$X$_8$X$_9$CRARQSIGTAIHWYQQKX$_{10}$X$_{11}$X$_{12}$X$_{13}$PX$_{14}$LLIX$_{15}$YASESISGX$_{16}$PSRFSGSGSGTDFTLTIX$_{17}$SX$_{18}$QXNEDX$_{20}$AX$_{21}$YCQQSX$_{22}$SWPYTFGX$_{23}$GTKLEIK wherein, $X_1$ is L or M; $X_2$ is G or S; $X_3$ is I or S; $X_4$ is V or A; $X_5$ is P or V; $X_6$ is E or D; $X_7$ is S or T; $X_8$ is F or I; $X_9$ is S or T; $X_{10}$ is T or P; is N or G; $X_{12}$ is G or K; $X_{13}$ is S or A; $X_{14}$ is R or K; $X_{15}$ is K or Y; $X_{16}$ is I or V; $X_{17}$ is N or S; $X_{18}$ is V or L; $X_{19}$ is S or P; $X_{20}$ is I or F; $X_{21}$ is D or T; $X_{22}$ is N or G; or $X_{23}$ is G or Q.

Epitope Identification

The epitope on CD3 was determined by hydrogen-deuterium exchange mass spectrometry (HDX-MS). The antibody clone OKT3 was used as a control for the HDX experiment, since its epitope on CD3ε was known from crystal structure (PDB ID 1SY6) (Kjer-Nielsen, L. et al.; Proc Natl Acad Sci US A 101, 7675-7680).

On-Exchange Experiment for HDX-MS.

On-exchange reaction was initiated by mixing 10 μL of 10 μM CD3W220 (SEQ ID NO: 375), which was comprised of CD3εγ fused with a 26-aa linker region fused onto a serum albumin domain, with or without 1.2 molar-excess of ligand and 30 μL of H$_2$O or a deuterated buffer (20 mM MES, pH 6.4, 150 mM NaCl in 95% D20 or 20 mM Tris, pH 8.4, 150 mM NaCl in 95% D20). The reaction mixture was incubated for 15, 50, 150, 500, or 1,500 s at 1.2° C. The on-exchanged solution was quenched by the addition of chilled 40 μL of 8 M urea, 1 M TCEP, pH 3.0 and immediately analyzed.

CD3W220 (CD3εγ-HSA-6xHis) (SEQ ID NO: 375):
QDGNEEMGGITQTPYKVSISGTTVILTCPQYPGSEILWQHNDKNIGGDEDD

KNIGSDEDHLSLKEFSELEQSGYYVCYPRGSKPEDANFYLYLRARVGSADD

AKKDAAKKDDAKKDDAKKDGISQSIKGNHLVKVYDYQEDGSVLLTCDAEAK

NITWFKDGKMIGFLTEDKKKWNLGSNAKDPRGMYQCKGSQNKSKPLQVYYR

NIGGGSDAHKSEVAHRFKDLGEENFKALVLIAFAQYLQQSPFEDHVKLVNE

VTEFAKTCVADESAENCDKSLHTLFGDKLCTVATLRETYGEMADCCAKQEP

ERNECFLQHKDDNPNLPRLVRPEVDVMCTAFHDNEETFLKKYLYEIARRHP

YFYAPELLFFAKRYKAAFTECCQAADKAACLLPKLDELRDEGKASSAKQRL

-continued

```
KCASLQKFGERAFKAWAVARLSQRFPKAEFAEVSKLVTDLTKVHTECCHGD

LLECADDRADLAKYICENQDSISSKLKECCEKPLLEKSHCIAEVENDEMPA

DLPSLAADFVESKDVCKNYAEAKDVFLGMFLYEYARRHPDYSVVLLLRLAK

TYETTLEKCCAAADPHECYAKVFDEFKPLVEEPQNLIKQNCELFEQLGEYK

FQNALLVRYTKKVPQVSTPTLVEVSRNLGKVGSKCCKHPEAKRMPCAEDYL

SVVLNQLCVLHEKTPVSDRVTKCCTESLVNRRPCFSALEVDETYVPKEFNA

ETFTFHADICTLSEKERQIKKQTALVELVKHKPKATKEQLKAVMDIDFAAF

VEKCCKADDKETCFAEEGKKLVAASQAALGLGGGSHHHEIHHHH
```

General Procedure for HDX-MS Data Acquisition. HDX-MS sample preparation was performed with automated HDx system (LEAP Technologies, Morrisville, NC). The columns and pump were; protease, protease type XIII (protease from *Aspergillus saitoi*, type XIII)/pepsin column (w/w, 1:1; 2.1×30 mm) (NovaBioAssays Inc., Woburn, MA); trap, ACQUITY UPLC BEH C18 VanGuard Pre-column (2.1×5 mm) (Waters, Milford, MA), analytical, Accucore C18 (2.1× 100 mm) (Thermo Fisher Scientific, Waltham, MA); and LC pump, VH-P10-A (Thermo Fisher Scientific). The loading pump (from the protease column to the trap column) was set at 600 µL/min with 99% water, 1% acetonitrile, 0.1% formic acid. The gradient pump (from the trap column to the analytical column) was set from 8% to 28% acetonitrile in 0.1% aqueous formic acid in 20 min at 1004/min.

MS Data Acquisition.

Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-1,800.

HDX-MS Data Extraction.

BioPharma Finder 3.0 (Thermo Fisher Scientific) was used for the peptide identification of non-deuterated samples prior to the HDX experiments. HDExaminer version 2.5 (Sierra Analytics, Modesto, CA) was used to extract centroid values from the MS raw data files for the HDX experiments.

HDX-MS Data Analysis.

The extracted HDX-MS data were further analyzed in Excel. All exchange time points (at pH 6.4 or pH 8.4 at 1.2° C.) were converted to the equivalent time points at pH 7.4 and 23° C. (e.g., 15 s at pH 6.4 at 1.2° C. is equivalent of 0.15 s at pH 7.4 at 23° C.; Table 33).

TABLE 33

| HDX reaction conditions and exchange times versus exchange times corrected to pH 7.4 and 23° C. | | |
|---|---|---|
| Time adjusted to pH 7.4, 23° C. (s) | pH 6.4 1.2° C. (s) | pH 8.4 1.2° C. (s) |
| 0.015 | — | — |
| 0.05 | — | — |

TABLE 33-continued

| HDX reaction conditions and exchange times versus exchange times corrected to pH 7.4 and 23° C. | | |
|---|---|---|
| Time adjusted to pH 7.4, 23° C. (s) | pH 6.4 1.2° C. (s) | pH 8.4 1.2° C. (s) |
| 0.15 | 15 | — |
| 0.5 | 50 | — |
| 1.5 | 150 | — |
| 5 | 500 | — |
| 15 | 1,500 | 15 |
| 50 | — | 50 |
| 150 | — | 150 |
| 500 | — | 500 |
| 1,500 | — | 1,500 |

Results.

Incubation of the KLCB91, the bispecific antibodies containing CD3W245 as an anti-CD3 arm, with recombinant CD3E resulted in different patterns of overall protection and degrees of protection at specific segments of the antigen. KLCB91 and OKT3 both protected non-continuous segments (FIG. 14) indicating conformational non-identical epitopes. The protected segments were mapped onto the crystal structure of CD3ε (PDB 1SY6) to visualize the binding epitopes in three dimensions.

Figure 14:
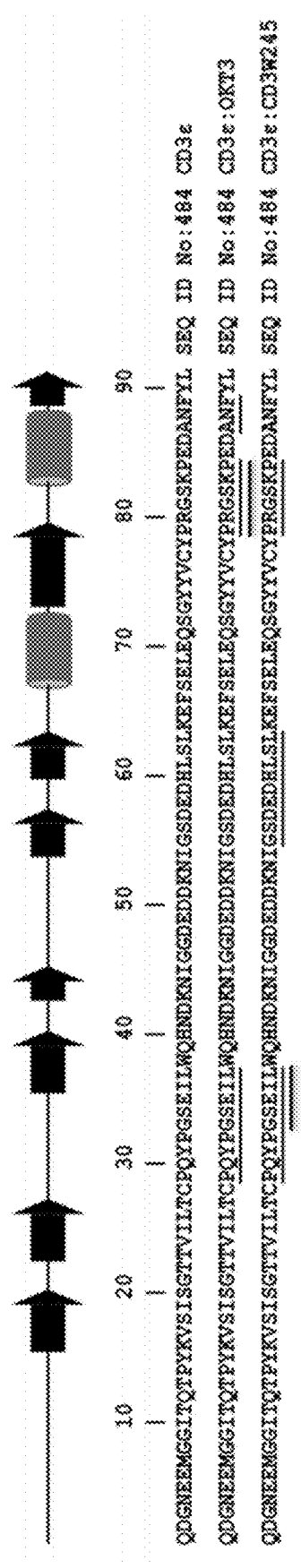
FIG. 14 shows hydrogen-deuterium exchange rates determined using hydrogen-deuterium exchange mass spectrometry (HDX-MS) measured for the complex of CD3W245 bound to human CD3ε (CD3ε:CD3W245), or the complex of OKT3 bound to human CD3ε (CD3ε:OKT3) (SEQ ID No: 484 which is a fragment of SEQ ID No: 375 is shown). Single underline indicates segments with 10%-30% decrease in deuteration levels and double underline indicates segments with >30% decrease in deuteration levels in the presence of the antibody, as compared to CD3ε alone.
Figure 15A:
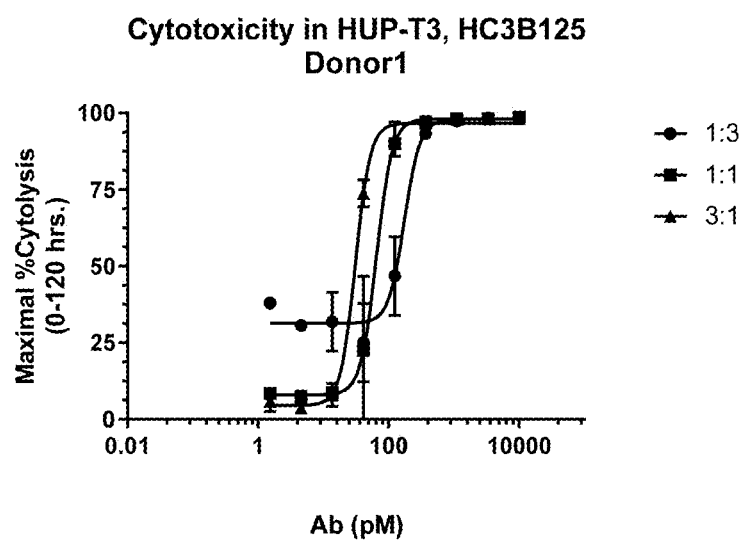
FIGS. 15A-15B show cytotoxicity of HC3B125 against HLA-G expressing tumor cells HUP-T3 and % T-cell activation.
Figure 15B:
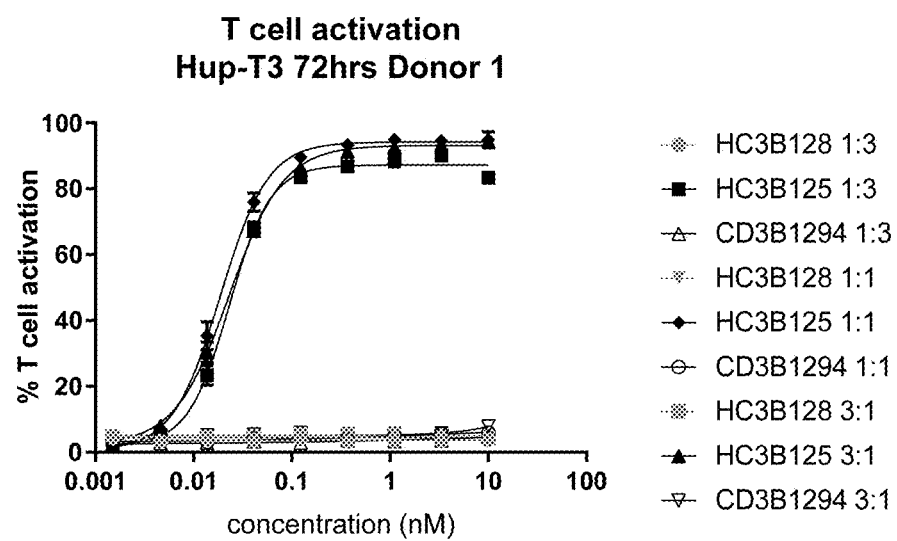
Figure 15C:
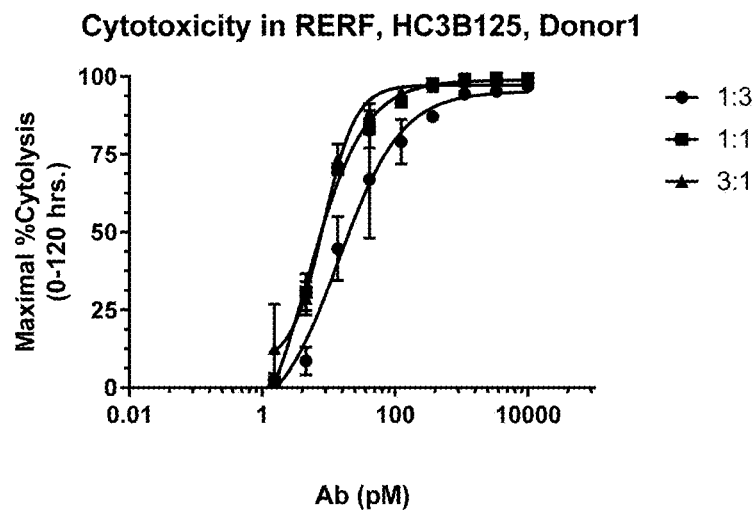
FIGS. 15C-15D show cytotoxicity of HC3B125 against HLA-G expressing tumor cells RERF-LC-Ad-1 and % T-cell activation.
Figure 15D:
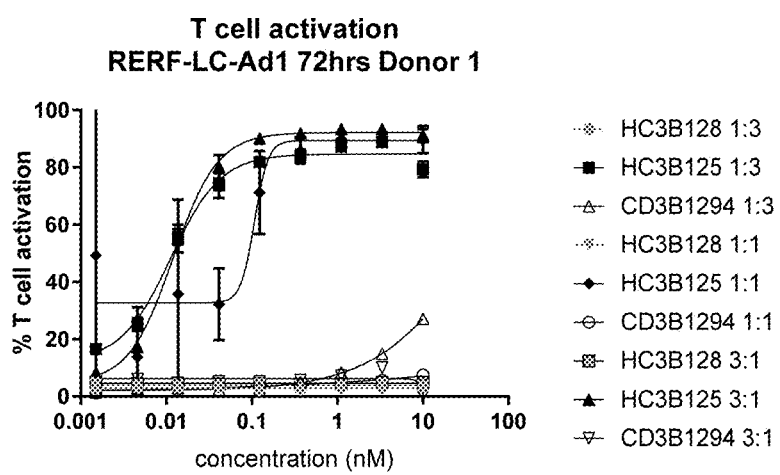

Consistent with the crystal structure of OKT3 bound to CD3ε (Uniprot ID P07766), the epitope of OKT3 was found to consist of peptides covering spanning residues 29-37, 79-84, and 87-89 of CD3ε (SEQ ID NO: 375 and FIG. 14). CD3W245 bound to an epitope partially overlapping with that of OKT3, and included amino acid residues 29-37, 55-63, and 79-84 of CD3ε (SEQ ID NO: 375 and FIG. 14).

Binding of Humanized Anti-CD3 scFv Variants to CD3 after Heat Shock.

The variable regions of the anti-CD3 molecules were formatted as scFv in VH-VL orientation using linker GTEGKSSGSGSESKST (SEQ ID No: 376) (Table 34) for expression in *E. coli*, and then screened for binding to recombinant CD3 (homodimeric CD3εγ-Fc, CD3W147, SEQ ID NO: 377), binding to T cells, and thermostability.

```
CD3W147 (SEQ ID NO: 377):
QDGNEEMGGITQTPYKVSISGTTVILTCPQYPGSEILWQHNDKNIGGDEDD

KNIGSDEDHLSLKEFSELEQSGYYVCYPRGSKPEDANFYLYLRARVGSADD

AKKDAAKKDDAKKDDAKKDGSQSIKGNHLVKVYDYQEDGSVLLTCDAEAKN

ITWFKDGKMIGFLTEDKKKWNLGSNAKDPRGMYQCKGSQNKSKPLQVYYRM

GSGSLGGPSVFLFPPKPKDTLMISRTPEVTCVVVDVSQEDPEVQFNWYVDG

VEVHNAKTKPREEQFNSTYRVVSVLTVLHQDWLNGKEYKCKVSNKGLPSSI

EKTISKAKGQPREPQVYTFPPSQEEMTKNQVSLRCLVKGFYPSDIAVEWES

NGQPENNYKTTKPVLDSDGSFRLESRLTVDKSRWQEGNVFSCSVMHEALHN

HYTQKSLSLSGGHHHHHH
```

TABLE 34

| csFv-HL-E.c. amino acid sequences. | | |
|---|---|---|
| scFv | SEQ ID NO: | Amino acid sequence |
| CD3W234-HL-E.c. | 378 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL |

TABLE 34-continued

| csFv-HL-E.c. amino acid sequences. | | |
|---|---|---|
| scFv | SEQ ID NO: | Amino acid sequence |
| | | VTVSSGTEGKSSGSGSESKSTDILLTQSPGILSVSPGERV SFSCRARQSIGTAIHWYQQRTNGSPRLLIKYASESISGIP SRFSGSGSGTDFTLTINSVESEDIADYYCQQSNSWPYTF GGGTKLEIKGPGGQHHHHHHGAYPYDVPDYAS |
| CD3W238-HL-E.c. | 379 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIYYASESISG VPSRFSGSGSGTDFTLTISSLQPEDFATYYCQQSNSWPY TFGQGTKLEIKGPGGQHHHHHHGAYPYDVPDYAS |
| CD3W242-HL-E.c. | 380 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSLQPEDFATYYCQQSNSWPY TFGQGTKLEIKGPGGQHHHHHHGAYPYDVPDYAS |
| CD3W243-HL-E.c. | 381 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSVQPEDFATYYCQQSNSWPY TFGQGTKLEIKGPGGQHHHHHHGAYPYDVPDYAS |
| CD3W244-HL-E.c. | 382 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIYYASESISG VPSRFSGSGSGTDFTLTISSVQPEDFATYYCQQSGSWPY TFGQGTKLEIKGPGGQHHHHHHGAYPYDVPDYAS |
| CD3W245-HL-E.c. | 383 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSLQPEDFATYYCQQSGSWPY TFGQGTKLEIKGPGGQHHHHHHGAYPYDVPDYAS |
| CD3W246-HL-E.c. | 384 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSVQPEDFATYYCQQSGSWPY TFGQGTKLEIKGPGGQHHHHHHGAYPYDVPDYAS |
| CD3W247-HL-E.c. | 385 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIYYASESISG VPSRFSGSGSGTDFTLTISSLQPEDFATYYCQQSGSWPY TFGQGTKLEIKGPGGQHHHHHHGAYPYDVPDYAS |
| CD3W248-HL-E.c. | 386 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDILLTQSPGILSVSPGERV SFSCRARQSIGTAIHWYQQRTNGSPRLLIKYASESISGIP SRFSGSGSGTDFTLTINSVESEDIADYYCQQSGSWPYTF GGGTKLEIKGPGGQHHHHHHGAYPYDVPDYAS |

Briefly, scFv-coding sequences were cloned into a pADL™-22c vector having a PelB leader sequence for secretion. E. coli cells were transformed with plasmid and grown overnight at 37° C. in 2×YT microbial growth medium supplemented with 100 μg/mL Carbenicillin. Protein expression was induced by addition of 1 mM IPTG and cultures were grown overnight. After expression, cells were pelleted by centrifugation at 2,200×g for 5 min and supernatants were collected and tested directly for binding to biotinylated CD3W147 by ELISA.

Figure 12:
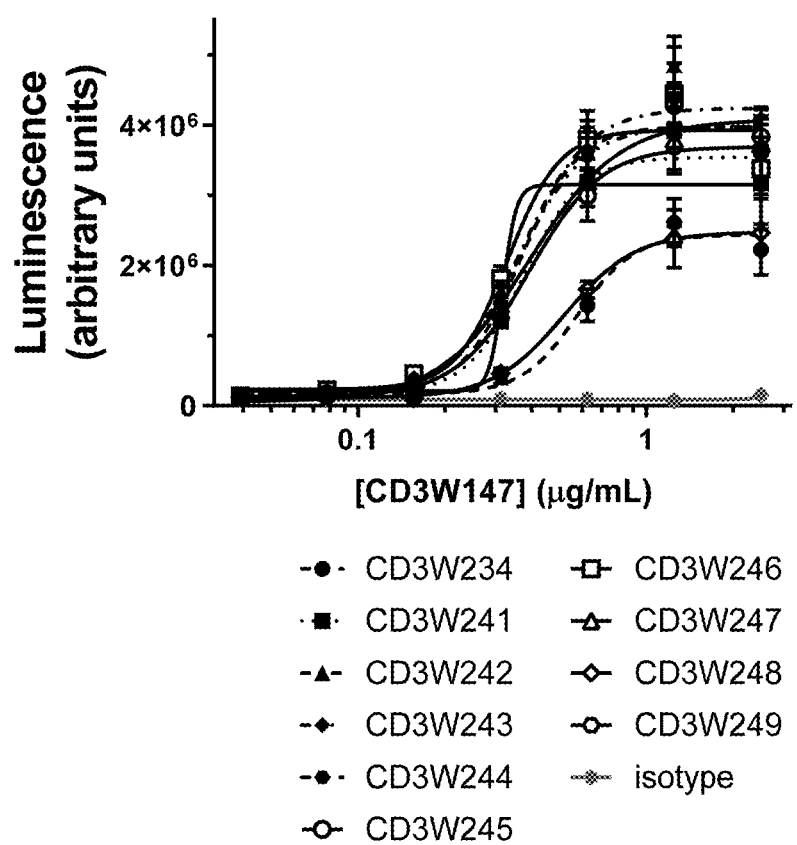
FIG. 12 shows binding of anti-CD3 scFv variants, expressed in E. coli, to CD3.

For ELISA analysis, botinylated CD3W147 (SEQ ID NO: 377) was immobilized on the plate in concentrations ranging from 0.039 ug/mL to 2.5 ug/mL in 2-fold dilutions followed by incubation at room temperature for 45 min. Bound scFv was detected using chicken anti-HA-horseradish peroxidase and then detected with chemiluminescence substrate. All tested scFv molecules derived from CD3B815 bound CD3ε (FIG. 12).

The scFv molecules were then tested for their abilities to bind T cells, using flow cytometry. Briefly, human T cells were thawed and resuspended into flow staining buffer at 1×10^6 cells/mL and plated at 50,000 cells/well. A positive control, CD3W36 was comprised of an anti-CD3 antibody SP34 formatted as LH-scFv, and a negative control, B23, an scFv targeted against the F-glycoprotein from respiratory syncytial virus, were used for comparison of binding. E. coli supernatants were added at 150 μL/well and incubated at 4° C. for 1 hr. After incubation, plates were washed with staining buffer and detected with anti-His antibody conjugated to Alexa-647 in staining buffer. After incubation, 200 μL of IntelliCyt running buffer was added to the mixture, and cells were resuspended in 30 μL running buffer containing 1:1,000 Sytox Green dead cell stain and analyzed on iQue Screener. Gating and analysis were performed as above. All scFv molecules derived from CD3B815 displayed mean fluorescence indices consistent with T cell binding (Table 35).

TABLE 35

T cell-based binding of humanized scFv molecules.

| Protein | MFI (n = 2) |
| --- | --- |
| CD3W245-HL-E.c. | 178140.0 |
| CD3W244-HL-E.c. | 165631.0 |
| CD3W246-HL-E.c. | 153895.8 |
| CD3W238-HL-E.c. | 137380.4 |
| CD3W242-HL-E.c. | 126105.9 |
| CD3W243-HL-E.c. | 111347.6 |
| CD3W241-HL-E.c. | 120793.8 |
| CD3W247-HL-E.c. | 110932.3 |
| CD3W248-HL-E.c. | 60437.1 |

TABLE 35-continued

T cell-based binding of humanized scFv molecules.

| Protein | MFI (n = 2) |
| --- | --- |
| CD3W234-HL-E.c. | 66790.3 |
| B23 | 51.8 |
| CD3W36 | 99451.6 |

Example 10: Generation of Bispecific HLA-G×CD3 Antibodies

The VH/VL regions of the anti-HLA-G antibodies generated in Example 1-3 and the VH/VL regions of the anti-CD3 antibody of Example 4 were engineered into bispecific format and expressed as IgG1.

Engineering of CD3 scFvs for HLA-G×CD3 Bispecific Generation

CD3 VH/VL regions were engineered as scFvs in either VH-Linker-VL or VL-linker-VH orientations using the linker of SEQ ID NO: 8 (Table 36). The VH-Linker-VL or VL-linker-VH scFv molecules binding CD3 were further engineered into a scFv-hinge-CH2-CH3 format comprising Fc silencing mutation (L234A/L235A/D265S) and the T350V/L351Y/F405A/Y407V mutations designed to promote selective heterodimerization (Table 37). The polypeptides of SEQ ID NOs: 387 or 492 were used as the constant domain hinge-CH2-CH3. DNA sequences of anti-CD3 molecules in scFv format and scFv-hinge-CH2-CH3 format are shown in Table 38.

(huIgG1_G1m(17)-hinge-Fc_C220S_AAS_ZWA)

SEQ ID NO: 387
EPKSSDKTHTCPPCPAPEAAGGPSVFLFPPKPKDTLMISRTPEVTCVVVSV
SHEDPEVKFNWYVDGVEVHNAKTKPREEQYNSTYRVVSVLTVLHQDWLNGK
EYKCKVSNKALPAPIEKTISKAKGQPREPQVYVYPPSREEMTKNQVSLTCL
VKGFYPSDIAVEWESNGQPENNYKTTPPVLDSDGSFALVSKLTVDKSRWQQ
GNVFSCSVMHEALHNHYTQKSLSLSPG

SEQ ID NO: 492
EPKSSDKTHTCPPCPAPEAAGGPSVFLFPPKPKDTLMISRTPEVTCVVVSV
SHEDPEVKFNWYVDGVEVHNAKTKPREEQYNSTYRVVSVLTVLHQDWLNGK
EYKCKVSNKALPAPIEKTISKAKGQPREPQVYVYPPSREEMTKNQVSLTCL
VKGFYPSDIAVEWESNGQPENNYKTTPPVLDSDGSFALVSKLTVDKSRWQQ
GNVFSCSVMHEALHNHYTQKSLSLSPGK

Table 36 Shows the scFv Sequences of Selected Anti-CD3 Antibodies

| Acronym | Amino acid Sequence of scFv | SEQ ID NO: |
| --- | --- | --- |
| CD3W244_HL | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKWYYASESISGVPSRFSGSGSGTDFTLTISSVQPEDFATYY CQQSGSWPYTFGQGTKLEIK | 388 |
| CD3W244_LH | DIQMTQSPSSLSASVGDRVTITCRARQSIGTAIHWYQQKPGKAPK LLIYYASESISGVPSRFSGSGSGTDFTLTISSVQPEDFATYYCQQSG SWPYTFGQGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSS | 389 |

-continued

| Acronym | Amino acid Sequence of scFv | SEQ ID NO: |
|---|---|---|
| CD3W245_HL | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKLLIKYASESISGVPSRFSGSGSGTDFTLTISSLQPEDFATYY CQQSGSWPYTFGQGTKLEIK | 390 |
| CD3W245_LH | DIQMTQSPSSLSASVGDRVTITCRARQSIGTAIHWYQQKPGKAPK LLIKYASESISGVPSRFSGSGSGTDFTLTISSLQPEDFATYYCQQSG SWPYTFGQGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSS | 391 |
| CD3W246_HL | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKLLIKYASESISGVPSRFSGSGSGTDFTLTISSVQPEDFATYY CQQSGSWPYTFGQGTKLEIK | 392 |
| CD3W246_LH | DIQMTQSPSSLSASVGDRVTITCRARQSIGTAIHWYQQKPGKAPK LLIKYASESISGVPSRFSGSGSGTDFTLTISSVQPEDFATYYCQQSG SWPYTFGQGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSS | 393 |
| CD3W247_HL | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKLLIYYASESISGVPSRFSGSGSGTDFTLTISSLQPEDFATYY CQQSGSWPYTFGQGTKLEIK | 394 |
| CD3W247_LH | DIQMTQSPSSLSASVGDRVTITCRARQSIGTAIHWYQQKPGKAPK LLIYYASESISGVPSRFSGSGSGTDFTLTISSLQPEDFATYYCQQSG SWPYTFGQGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSS | 395 |
| CD3W248_HL | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDILLTQSPGILSVSPGERVSFSCRARQSIGTAIHWYQQRTN GSPRLLIKYASESISGIPSRFSGSGSGTDFTLTINSVESEDIADYYCQ QSGSWPYTFGGGTKLEIK | 396 |
| CD3W248_LH | DILLTQSPGILSVSPGERVSFSCRARQSIGTAIHWYQQRTNGSPRL LIKYASESISGIPSRFSGSGSGTDFTLTINSVESEDIADYYCQQSGS WPYTFGGGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSS | 397 |
| CD3B450-LH | QSALTQPASVSGSPGQSITISCTGTSSNIGTYKFVSWYQQHPGKAPKVMI YEVSKRPSGVSNRFSGSKSGNTASLTISGLQAEDEADYYCVSYAGSGTL LFGGGTKLTVLGGSEGKSSGSGSESKSTGGSQVQLQQSGPGLVKPSQTL SLTCAISGDSVFNNNAAWSWIRQSPSRGLEWLGRTYYRSKWLYDYAVS VKSRITINPDTSKNQFSLQLNSVTPEDTAVYYCARGYSSSFDYWGQGTL VTVSS | 398 |
| CD3B219-LH | QTVVTQEPSLTVSPGGTVTLTCRSSTGAVTTSNYANWVQQKPGQAPRG LIGGTNKRAPGTPARFSGSLLGGKAALTLSGVQPEDEAEYYCALWYSN LWVFGGGTKLTVLGGSEGKSSGSGSESKSTGGSEVQLVESGGGLVQPG GSLRLSCAASGFTFNTYAMNWVRQAPGKGLEWVARIRSKYNNYATYY AASVKGRFTISRDDSKNSLYLQMNSLKTEDTAVYYCVRHGNFGNSYVS WFAYWGQGTLVTVSS | 399 |

-continued

| Acronym | Amino acid Sequence of scFv | SEQ ID NO: |
|---|---|---|
| null-scFv | DIQMTQSPSSLSASVGDRVTITCRASQSISSYLNWYQQKPGCAPKLLIYA ASSLQSGVPSRFSGSGSGTDFTLTISSLQPEDFATYYCQQSYSTPLTFGQG TKVEIKGGGSGGSGGCPPCGGSGGEVQLLESGGGLVQPGGSLRLSCAAS GFTFSSYAMSWVRQAPGKGLEWVSAISGSGGSTYYADSVKGRFTISRD NSKNTLYLQMNSLRAEDTAVYYCAKYDGIYGELDFWGCGTLVTVSS | 400 |

TABLE 37

Amino acid sequences of selected anti-CD3 scFv-Fc arms.

| Acronym | HC protein SEQ ID NO: | SEQ ID NO: |
|---|---|---|
| CD3W244-HL-Fc | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKWYYASESISGVPSRFSGSGSGTDFTLTISSVQPEDFATYY CQQSGSWPYTFGQGTKLEIKEPKSSDKTHTCPPCPAPEAAGGPSV FLFPPKPKDTLMISRTPEVTCVVVSVSHEDPEVKFNWYVDGVEV HNAKTKPREEQYNSTYRVVSVLTVLHQDWLNGKEYKCKVSNK ALPAPIEKTISKAKGQPREPQVYVYPPSREEMTKNQVSLTCLVKG FYPSDIAVEWESNGQPENNYKTTPPVLDSDGSFALVSKLTVDKSR WQQGNVFSCSVMHEALHNHYTQKSLSLSPGK | 401 |
| CD3W244-LH-Fc | DIQMTQSPSSLSASVGDRVTITCRARQSIGTAIHWYQQKPGKAPK LLIYYASESISGVPSRFSGSGSGTDFTLTISSVQPEDFATYYCQQSG SWPYTFGQGTKLEIKGGSEGKSSGSGSESKTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSSEPKSSDKTHTCPPCPAPEAAGGPSVF LFPPKPKDTLMISRTPEVTCVVVSVSHEDPEVKFNWYVDGVEVH NAKTKPREEQYNSTYRVVSVLTVLHQDWLNGKEYKCKVSNKA LPAPIEKTISKAKGQPREPQVYVYPPSREEMTKNQVSLTCLVKGF YPSDIAVEWESNGQPENNYKTTPPVLDSDGSFALVSKLTVDKSR WQQGNVFSCSVMHEALHNHYTQKSLSLSPGK | 402 |
| CD3W245-HL-Fc | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKLLIKYASESISGVPSRFSGSGSGTDFTLTISSLQPEDFATYY CQQSGSWPYTFGQGTKLEIKEPKSSDKTHTCPPCPAPEAAGGPSV FLFPPKPKDTLMISRTPEVTCVVVSVSHEDPEVKFNWYVDGVEV HNAKTKPREEQYNSTYRVVSVLTVLHQDWLNGKEYKCKVSNK ALPAPIEKTISKAKGQPREPQVYVYPPSREEMTKNQVSLTCLVKG FYPSDIAVEWESNGQPENNYKTTPPVLDSDGSFALVSKLTVDKSR WQQGNVFSCSVMHEALHNHYTQKSLSLSPGK | 403 |
| CD3W245-LH-Fc | DIQMTQSPSSLSASVGDRVTITCRARQSIGTAIHWYQQKPGKAPK LLIKYASESISGVPSRFSGSGSGTDFTLTISSLQPEDFATYYCQQSG SWPYTFGQGTKLEIKGGSEGKSSGSGSESKTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSSEPKSSDKTHTCPPCPAPEAAGGPSVF LFPPKPKDTLMISRTPEVTCVVVSVSHEDPEVKFNWYVDGVEVH NAKTKPREEQYNSTYRVVSVLTVLHQDWLNGKEYKCKVSNKA LPAPIEKTISKAKGQPREPQVYVYPPSREEMTKNQVSLTCLVKGF YPSDIAVEWESNGQPENNYKTTPPVLDSDGSFALVSKLTVDKSR WQQGNVFSCSVMHEALHNHYTQKSLSLSPGK | 404 |
| CD3W246-HL-Fc | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKLLIKYASESISGVPSRFSGSGSGTDFTLTISSVQPEDFATYY CQQSGSWPYTFGQGTKLEIKEPKSSDKTHTCPPCPAPEAAGGPSV FLFPPKPKDTLMISRTPEVTCVVVSVSHEDPEVKFNWYVDGVEV HNAKTKPREEQYNSTYRVVSVLTVLHQDWLNGKEYKCKVSNK ALPAPIEKTISKAKGQPREPQVYVYPPSREEMTKNQVSLTCLVKG FYPSDIAVEWESNGQPENNYKTTPPVLDSDGSFALVSKLTVDKSR WQQGNVFSCSVMHEALHNHYTQKSLSLSPG | 405 |

TABLE 37-continued

Amino acid sequences of selected anti-CD3 scFv-Fc arms.

| Acronym | HC protein SEQ ID NO: | SEQ ID NO: |
|---|---|---|
| CD3W246-LH-Fc | DIQMTQSPSSLSASVGDRVTITCRARQSIGTAIHWYQQKPGKAPK LLIKYASESISGVPSRFSGSGSGTDFTLTISSVQPEDFATYYCQQSG SWPYTFGQGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSSEPKSSDKTHTCPPCPAPEAAGGPSVF LFPPKPKDTLMISRTPEVTCVVVSVSHEDPEVKFNWYVDGVEVH NAKTKPREEQYNSTYRVVSVLTVLHQDWLNGKEYKCKVSNKA LPAPIEKTISKAKGQPREPQVYVYPPSREEMTKNQVSLTCLVKGF YPSDIAVEWESNGQPENNYKTTPPVLDSDGSFALVSKLTVDKSR WQQGNVFSCSVMHEALHNHYTQKSLSLSPGK | 406 |
| CD3W247-HL-Fc | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDIQMTQSPSSLSASVGDRVTITCRARQSIGTAIHWYQQKP GKAPKWYYASESISGVPSRFSGSGSGTDFTLTISSLQPEDFATYY CQQSGSWPYTFGQGTKLEIKEPKSSDKTHTCPPCPAPEAAGGPSV FLFPPKPKDTLMISRTPEVTCVVVSVSHEDPEVKFNWYVDGVEV HNAKTKPREEQYNSTYRVVSVLTVLHQDWLNGKEYKCKVSNK ALPAPIEKTISKAKGQPREPQVYVYPPSREEMTKNQVSLTCLVKG FYPSDIAVEWESNGQPENNYKTTPPVLDSDGSFALVSKLTVDKSR WQQGNVFSCSVMHEALHNHYTQKSLSLSPGK | 407 |
| CD3W247-LH-Fc | DIQMTQSPSSLSASVGDRVTITCRARQSIGTAIHWYQQKPGKAPK LLIYYASESISGVPSRFSGSGSGTDFTLTISSLQPEDFATYYCQQSG SWPYTFGQGTKLEIKGGSEGKSSGSGSESKSTGGSEVQLVESGGG LVKPGGSLRLSCAASGFTFSRYNMNWVRQAPGKGLEWVSSISTS SNYIYYADSVKGRFTFSRDNAKNSLDLQMSGLRAEDTAIYYCTR GWGPFDYWGQGTLVTVSSEPKSSDKTHTCPPCPAPEAAGGPSVF LFPPKPKDTLMISRTPEVTCVVVSVSHEDPEVKFNWYVDGVEVH NAKTKPREEQYNSTYRVVSVLTVLHQDWLNGKEYKCKVSNKA LPAPIEKTISKAKGQPREPQVYVYPPSREEMTKNQVSLTCLVKGF YPSDIAVEWESNGQPENNYKTTPPVLDSDGSFALVSKLTVDKSR WQQGNVFSCSVMHEALHNHYTQKSLSLSPGK | 408 |
| CD3W248-HL-Fc | EVQLVESGGGLVKPGGSLRLSCAASGFTFSRYNMNWVRQAPGK GLEWVSSISTSSNYIYYADSVKGRFTFSRDNAKNSLDLQMSGLR AEDTAIYYCTRGWGPFDYWGQGTLVTVSSGGSEGKSSGSGSESK STGGSDILLTQSPGILSVSPGERVSFSCRARQSIGTAIHWYQQRTN GSPRLLIKYASESISGIPSRFSGSGSGTDFTLTINSVESEDIADYYCQ QSGSWPYTFGGGTKLEIKEPKSSDKTHTCPPCPAPEAAGGPSVFL FPPKPKDTLMISRTPEVTCVVVSVSHEDPEVKFNWYVDGVEVHN AKTKPREEQYNSTYRVVSVLTVLHQDWLNGKEYKCKVSNKALP APIEKTISKAKGQPREPQVYVYPPSREEMTKNQVSLTCLVKGFYP SDIAVEWESNGQPENNYKTTPPVLDSDGSFALVSKLTVDKSRWQ QGNVFSCSVMHEALHNHYTQKSLSLSPGK | 409 |
| CD3W248-LH-Fc | DILLTQSPGILSVSPGERVSFSCRARQSIGTAIHWYQQRTNGSPRL LIKYASESISGIPSRFSGSGSGTDFTLTINSVESEDIADYYCQQSGS WPYTFGGGTKLEIKGGSEGKSSGSGSESKSTGGSEVQLVESGGGL VKPGGSLRLSCAASGFTFSRYNMNWVRQAPGKGLEWVSSISTSS NYIYYADSVKGRFTFSRDNAKNSLDLQMSGLRAEDTAIYYCTRG WGPFDYWGQGTLVTVSSEPKSSDKTHTCPPCPAPEAAGGPSVFL FPPKPKDTLMISRTPEVTCVVVSVSHEDPEVKFNWYVDGVEVHN AKTKPREEQYNSTYRVVSVLTVLHQDWLNGKEYKCKVSNKALP APIEKTISKAKGQPREPQVYVYPPSREEMTKNQVSLTCLVKGFYP SDIAVEWESNGQPENNYKTTPPVLDSDGSFALVSKLTVDKSRWQ QGNVFSCSVMHEALHNHYTQKSLSLSPGK | 410 |
| CD3B450-LH-Fc | QSALTQPASVSGSPGQSITISCTGTSSNIGTYKFVSWYQQHPGKAP KVMIYEVSKRPSGVSNRFSGSKSGNTASLTISGLQAEDEADYYC VSYAGSGTLLFGGGTKLTVLGGSEGKSSGSGSESKSTGGSQVQL QQSGPGLVKPSQTLSLTCAISGDSVFNNNAAWSWIRQSPSRGLE WLGRTYYRSKWLYDYAVSVKSRITINPDTSKNQFSLQLNSVTPE DTAVYYCARGYSSFDYWGQGTLVTVSSEPKSSDKTHTCPPCPA PEAAGGPSVFLFPPKPKDTLMISRTPEVTCVVVSVSHEDPEVKFN WYVDGVEVHNAKTKPREEQYNSTYRVVSVLTVLHQDWLNGKE YKCKVSNKALPAPIEKTISKAKGQPREPQVYVYPPSREEMTKNQ VSLTCLVKGFYPSDIAVEWESNGQPENNYKTTPPVLDSDGSFAL VSKLTVDKSRWQQGNVFSCSVMHEALHNHYTQKSLSLSPG | 411 |
| CD3B219-LH-Fc | QTVVTQEPSLTVSPGGTVTLTCRSSTGAVTTSNYANWVQQKPGQ APRGLIGGTNKRAPGTPARFSGSLLGGKAALTLSGVQPEDEAEY YCALWYSNLWVFGGGTKLTVLGGSEGKSSGSGSESKSTGGSEV | 412 |

TABLE 37-continued

Amino acid sequences of selected anti-CD3 scFv-Fc arms.

| Acronym | HC protein SEQ ID NO: | SEQ ID NO: |
|---|---|---|
| | QLVESGGGLVQPGGSLRLSCAASGFTFNTYAMNWVRQAPGKGL EWVARIRSKYNNYATYYAASVKGRFTISRDDSKNSLYLQMNSL KTEDTAVYYCVRHGNFGNSYVSWFAYWGQGTLVTVSSEPKSSD KTHTCPPCPAPEAAGGPSVFLFPPKPKDTLMISRTPEVTCVVVSV SHEDPEVKFNWYVDGVEVHNAKTKPREEQYNSTYRVVSVLTVL HQDWLNGKEYKCKVSNKALPAPIEKTISKAKGQPREPQVYVYPP SREEMTKNQVSLTCLVKGFYPSDIAVEWESNGQPENNYKTTPPV LDSDGSFALVSKLTVDKSRWQQGNVFSCSVMHEALHNHYTQKS LSLSPG | |
| null-scFv-Fc | DIQMTQSPSSLSASVGDRVTITCRASQSISSYLNWYQQKPGCAPKLLIYA ASSLQSGVPSRFSGSGSGTDFTLTISSLQPEDFATYYCQQSYSTPLTFGQG TKVEIKGGGSGGSGGCPPCGGSGGEVQLLESGGGLVQPGGSLRLSCAAS GFTFSSYAMSWVRQAPGKGLEWVSAISGSGGSTYYADSVKGRFTISRD NSKNTLYLQMNSLRAEDTAVYYCAKYDGIYGELDFWGCGTLVTVSSEP KSSDKTHTCPPCPAPEAAGGPSVFLFPPKPKDTLMISRTPEVTCVVVSVS HEDPEVKFNWYVDGVEVHNAKTKPREEQYNSTYRVVSVLTVLHQDW LNGKEYKCKVSNKALPAPIEKTISKAKGQPREPQVYVYPPSREEMTKNQ VSLTCLVKGFYPSDIAVEWESNGQPENNYKTTPPVLDSDGSFALVSKLT VDKSRWQQGNVFSCSVMHEALHNHYTQKSLSLSPG | 413 |

TABLE 38

DNA SEQ ID NOs for anti-CD3 scFv and scFv-hinge-CH2-CH3 (scFv-Fc)

| | scFv DNA SEQ ID NO | scFv-Fc DNA SEQ ID NO |
|---|---|---|
| CD3W244_HL | 414 | 426 |
| CD3W244_LH | 415 | 427 |
| CD3W245_HL | 416 | 428 |
| CD3W245_LH | 417 | 429 |
| CD3W246_HL | 418 | 430 |
| CD3W246_LH | 419 | 431 |
| CD3W247_HL | 420 | 432 |
| CD3W247_LH | 421 | 433 |
| CD3W248_HL | 422 | 434 |
| CD3W248_LH | 423 | 435 |
| CD3B450_LH | 424 | 436 |
| CD3B219_LH | 425 | 437 |

(CD3W244_HL)

SEQ ID NO: 414

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAG (CD3W244_LH)

SEQ ID NO: 415

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

-continued

```
TCAGCGGCAGCGGCAGCGGCACCGACTTCACCCTGACCATCAGCAGCGTGCAGCCAGAGGA
CTTCGCCACCTACTACTGCCAGCAGAGCGGCAGCTGGCCATACACCTTCGGCCAGGGCACCA
AGCTGGAGATCAAGGGCGGATCTGAGGGAAAGTCCAGCGGCTCCGGCAGCGAAAGCAAGTC
CACCGGCGGAAGCGAGGTGCAGCTGGTGGAGAGCGGTGGCGGTCTGGTGAAGCCAGGTGGC
AGCCTGCGCCTGAGCTGTGCCGCCAGCGGTTTCACCTTCAGCCGCTACAACATGAACTGGGT
GCGCCAAGCCCCAGGCAAGGGCCTGGAGTGGGTGAGCAGCATCAGCACCAGCAGCAACTAC
ATCTACTACGCCGACAGCGTGAAGGGCCGCTTCACCTTCAGCCGCGACAACGCCAAGAACA
GCCTGGACCTGCAGATGAGCGGTCTGCGCGCCGAGGACACCGCCATCTACTACTGCACCCGC
GGTTGGGGCCCATTCGACTACTGGGGCCAGGGCACCCTGGTGACCGTGAGCAGC
```

(CD3W245_HL)                                                SEQ ID NO: 416
```
GAGGTGCAGCTGGTGGAGAGCGGTGGCGGTCTGGTGAAGCCAGGTGGCAGCCTGCGCCTGA
GCTGTGCCGCCAGCGGTTTCACCTTCAGCCGCTACAACATGAACTGGGTGCGCCAAGCCCCA
GGCAAGGGCCTGGAGTGGGTGAGCAGCATCAGCACCAGCAGCAACTACATCTACTACGCCG
ACAGCGTGAAGGGCCGCTTCACCTTCAGCCGCGACAACGCCAAGAACAGCCTGGACCTGCA
GATGAGCGGTCTGCGCGCCGAGGACACCGCCATCTACTACTGCACCCGCGGTTGGGGCCCAT
TCGACTACTGGGGCCAGGGCACCCTGGTGACCGTGAGCAGCGGCGGATCTGAGGGAAAGTC
CAGCGGCTCCGGCAGCGAAAGCAAGTCCACCGGCGGAAGCGACATCCAGATGACCCAGAGC
CCAAGCAGCCTGAGCGCCAGCGTCGGCGACCGCGTGACCATCACCTGTCGTGCCCGCCAGA
GCATCGGCACCGCCATCCACTGGTACCAGCAGAAGCCAGGCAAGGCCCCAAAGCTGCTGAT
CAAGTACGCCAGCGAGAGCATCAGCGGTGTGCCAAGCCGCTTCAGCGGCAGCGGCAGCGGC
ACCGACTTCACCCTGACCATCAGCAGCCTGCAGCCAGAGGACTTCGCCACCTACTACTGCCA
GCAGAGCGGCAGCTGGCCATACACCTTCGGCCAGGGCACCAAGCTGGAGATCAAG
```

(CD3W245_LH)                                                SEQ ID NO: 417
```
GACATCCAGATGACCCAGAGCCCAAGCAGCCTGAGCGCCAGCGTCGGCGACCGCGTGACCA
TCACCTGTCGTGCCCGCCAGAGCATCGGCACCGCCATCCACTGGTACCAGCAGAAGCCAGGC
AAGGCCCCAAAGCTGCTGATCAAGTACGCCAGCGAGAGCATCAGCGGTGTGCCAAGCCGCT
TCAGCGGCAGCGGCAGCGGCACCGACTTCACCCTGACCATCAGCAGCCTGCAGCCAGAGGA
CTTCGCCACCTACTACTGCCAGCAGAGCGGCAGCTGGCCATACACCTTCGGCCAGGGCACCA
AGCTGGAGATCAAGGGCGGATCTGAGGGAAAGTCCAGCGGCTCCGGCAGCGAAAGCAAGTC
CACCGGCGGAAGCGAGGTGCAGCTGGTGGAGAGCGGTGGCGGTCTGGTGAAGCCAGGTGGC
AGCCTGCGCCTGAGCTGTGCCGCCAGCGGTTTCACCTTCAGCCGCTACAACATGAACTGGGT
GCGCCAAGCCCCAGGCAAGGGCCTGGAGTGGGTGAGCAGCATCAGCACCAGCAGCAACTAC
ATCTACTACGCCGACAGCGTGAAGGGCCGCTTCACCTTCAGCCGCGACAACGCCAAGAACA
GCCTGGACCTGCAGATGAGCGGTCTGCGCGCCGAGGACACCGCCATCTACTACTGCACCCGC
GGTTGGGGCCCATTCGACTACTGGGGCCAGGGCACCCTGGTGACCGTGAGCAGC
```

(CD3W246_HL)                                                SEQ ID NO: 418
```
GAGGTGCAGCTGGTGGAGAGCGGTGGCGGTCTGGTGAAGCCAGGTGGCAGCCTGCGCCTGA
GCTGTGCCGCCAGCGGTTTCACCTTCAGCCGCTACAACATGAACTGGGTGCGCCAAGCCCCA
GGCAAGGGCCTGGAGTGGGTGAGCAGCATCAGCACCAGCAGCAACTACATCTACTACGCCG
ACAGCGTGAAGGGCCGCTTCACCTTCAGCCGCGACAACGCCAAGAACAGCCTGGACCTGCA
```

```
GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CAAGTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAG
```

(CD3W246_LH)

SEQ ID NO: 419

```
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGC
```

(CD3W247_HL)

SEQ ID NO: 420

```
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAG
```

(CD3W247_LH)

SEQ ID NO: 421

```
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC
```

-continued

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGC (CD3W248_HL)
SEQ ID NO: 422

GAGGTGCAACTGGTGGAGTCTGGGGGAGGCCTGGTCAAGCCTGGGGGGTCCCTGAGACTCT

CCTGTGCAGCCTCTGGATTCACCTTCAGTAGATATAACATGAACTGGGTCCGCCAGGCTCCA

GGGAAGGGGCTGGAGTGGGTCTCATCCATTAGTACTAGTAGTAATTACATATACTACGCAGA

CTCAGTGAAGGGCCGATTCACCTTCTCCAGAGACAACGCCAAGAACTCACTGGATCTGCAAA

TGAGCGGCCTGAGAGCCGAGGACACGGCTATTTATTACTGTACGAGAGGCTGGGGGCCTTTT

GACTACTGGGGCCAGGGAACCCTGGTCACCGTCTCCTCAGGCGGATCTGAGGGAAAGTCCA

GCGGCTCCGGCAGCGAAAGCAAGTCCACCGGCGGAAGCGACATCTTGCTGACTCAGTCTCC

AGGCATCCTGTCTGTGAGTCCAGGAGAAAGAGTCAGTTTCTCCTGCAGGGCCAGACAGAGC

ATTGGCACAGCCATACACTGGTATCAGCAAAGAACAAATGGTTCTCCAAGGCTTCTCATAAA

GTATGCTTCTGAGTCTATCTCTGGGATCCCTTCCAGGTTTAGCGGCAGTGGATCAGGGACAG

ATTTTACTCTTACCATCAACAGTGTGGAGTCTGAAGATATTGCAGATTATTACTGTCAACAA

AGTGGGAGCTGGCCGTACACGTTCGGAGGGGGGACCAAGCTGGAAATAAAA (CD3W248_LH)
SEQ ID NO: 423

GACATCTTGCTGACTCAGTCTCCAGGCATCCTGTCTGTGAGTCCAGGAGAAAGAGTCAGTTT

CTCCTGCAGGGCCAGACAGAGCATTGGCACAGCCATACACTGGTATCAGCAAAGAACAAAT

GGTTCTCCAAGGCTTCTCATAAAGTATGCTTCTGAGTCTATCTCTGGGATCCCTTCCAGGTTT

AGCGGCAGTGGATCAGGGACAGATTTTACTCTTACCATCAACAGTGTGGAGTCTGAAGATAT

TGCAGATTATTACTGTCAACAAAGTGGGAGCTGGCCGTACACGTTCGGAGGGGGGACCAAG

CTGGAAATAAAAGGCGGATCTGAGGGAAAGTCCAGCGGCTCCGGCAGCGAAAGCAAGTCCA

CCGGCGGAAGCGAGGTGCAACTGGTGGAGTCTGGGGGAGGCCTGGTCAAGCCTGGGGGGTC

CCTGAGACTCTCCTGTGCAGCCTCTGGATTCACCTTCAGTAGATATAACATGAACTGGGTCC

GCCAGGCTCCAGGGAAGGGGCTGGAGTGGGTCTCATCCATTAGTACTAGTAGTAATTACATA

TACTACGCAGACTCAGTGAAGGGCCGATTCACCTTCTCCAGAGACAACGCCAAGAACTCACT

GGATCTGCAAATGAGCGGCCTGAGAGCCGAGGACACGGCTATTTATTACTGTACGAGAGGC

TGGGGGCCTTTTGACTACTGGGGCCAGGGAACCCTGGTCACCGTCTCCTCA (CD3W244_HL-scFv-Fc)
SEQ ID NO: 426

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

-continued

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W244_LH-scFv-Fc)

SEQ ID NO: 427

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA

AATCTAGCGACAAAACTCACACATGTCCACCGTGCCCAGCACCTGAAGCAGCAGGGGGACC

GTCAGTCTTCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

GGAGAGCAATGGGCAGCCGGAGAACAACTACAAGACCACGCCTCCCGTGCTGGACTCCGAC

```
GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA
```

(CD3W245_HL-scFv-Fc)
SEQ ID NO: 428

```
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CAAGTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA
```

(CD3W245_LH-scFv-Fc)
SEQ ID NO: 429

```
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGT

CCACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA
```

-continued

AATCTAGCGACAAAACTCACACATGTCCACCGTGCCCAGCACCTGAAGCAGCAGGGGGACC

GTCAGTCTTCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

GGAGAGCAATGGGCAGCCGGAGAACAACTACAAGACCACGCCTCCCGTGCTGGACTCCGAC

GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA (CD3W246_HL-scFv-Fc)

SEQ ID NO: 430

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCAGGCAAGGCCCCCAAAGCTGCTGAT

CAAGTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W246_LH-scFv-Fc)

SEQ ID NO: 431

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCAGGC

-continued

```
AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA

AATCTAGCGACAAAACTCACACATGTCCACCGTGCCCAGCACCTGAAGCAGCAGGGGACC

GTCAGTCTTCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

GGAGAGCAATGGGCAGCCGGAGAACAACTACAAGACCACGCCTCCCGTGCTGGACTCCGAC

GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA
```

(CD3W247_HL-scFv-Fc) SEQ ID NO: 432

```
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA
```

-continued

AAGGGCAGCCCCGAGAACCACAGGTGTACGTGTACCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W247_LH-scFv-Fc)

SEQ ID NO: 433

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA

AATCTAGCGACAAAACTCACACATGTCCACCGTGCCCAGCACCTGAAGCAGCAGGGGGACC

GTCAGTCTTCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

GGAGAGCAATGGGCAGCCGGAGAACAACTACAAGACCACGCCTCCCGTGCTGGACTCCGAC

GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA (CD3W248_HL-scFv-Fc)

SEQ ID NO: 434

GAGGTGCAACTGGTGGAGTCTGGGGGAGGCCTGGTCAAGCCTGGGGGTCCCTGAGACTCT

CCTGTGCAGCCTCTGGATTCACCTTCAGTAGATATAACATGAACTGGGTCCGCCAGGCTCCA

GGGAAGGGGCTGGAGTGGGTCTCATCCATTAGTACTAGTAGTAATTACATATACTACGCAGA

CTCAGTGAAGGGCCGATTCACCTTCTCCAGAGACAACGCCAAGAACTCACTGGATCTGCAAA

TGAGCGGCCTGAGAGCCGAGGACACGGCTATTTATTACTGTACGAGAGGCTGGGGGCCTTTT

GACTACTGGGGCCAGGGAACCCTGGTCACCGTCTCCTCAGGCGGATCTGAGGGAAAGTCCA

GCGGCTCCGGCAGCGAAAGCAAGTCCACCGGCGGAAGCGACATCTTGCTGACTCAGTCTCC

AGGCATCCTGTCTGTGAGTCCAGGAGAAAGAGTCAGTTTCTCCTGCAGGGCCAGACAGAGC

-continued

ATTGGCACAGCCATACACTGGTATCAGCAAAGAACAAATGGTTCTCCAAGGCTTCTCATAAA

GTATGCTTCTGAGTCTATCTCTGGGATCCCTTCCAGGTTTAGCGGCAGTGGATCAGGGACAG

ATTTTACTCTTACCATCAACAGTGTGGAGTCTGAAGATATTGCAGATTATTACTGTCAACAA

AGTGGGAGCTGGCCGTACACGTTCGGAGGGGGACCAAGCTGGAAATAAAAGAGCCCAAAT

CTAGCGACAAAACTCACACATGTCCACCGTGCCCAGCACCTGAAGCAGCAGGGGACCGTC

AGTCTTCCTCTTCCCCCCAAAACCCAAGGACACCCTCATGATCTCCCGGACCCCTGAGGTCA

CATGCGTGGTGGTGAGCGTGAGCCACGAAGACCCTGAGGTCAAGTTCAACTGGTACGTGGA

CGGCGTGGAGGTGCATAATGCCAAGACAAAGCCGCGGGAGGAGCAGTACAACAGCACGTA

CCGTGTGGTCAGCGTCCTCACCGTCCTGCACCAGGACTGGCTGAATGGCAAGGAGTACAAGT

GCAAGGTCTCCAACAAAGCCCTCCCAGCCCCCATCGAGAAAACCATCTCCAAAGCCAAAGG

GCAGCCCCGAGAACCACAGGTGTACGTGTACCCCCCATCCCGGGAGGAGATGACCAAGAAC

CAGGTCAGCCTGACCTGCCTGGTCAAAGGCTTCTATCCCAGCGACATCGCCGTGGAGTGGGA

GAGCAATGGGCAGCCGGAGAACAACTACAAGACCACGCCTCCCGTGCTGGACTCCGACGGC

TCCTTCGCCCTCGTGAGCAAGCTCACCGTGGACAAGTCTAGATGGCAGCAGGGGAACGTCTT

CTCATGCTCCGTGATGCATGAGGCTCTGCACAACCACTACACGCAGAAGAGCCTCTCCCTGT

CTCCGGGTAAA (CD3W248_LH-scFv-Fc)

SEQ ID NO: 435

GACATCTTGCTGACTCAGTCTCCAGGCATCCTGTCTGTGAGTCCAGGAGAAAGAGTCAGTTT

CTCCTGCAGGGCCAGACAGAGCATTGGCACAGCCATACACTGGTATCAGCAAAGAACAAAT

GGTTCTCCAAGGCTTCTCATAAAGTATGCTTCTGAGTCTATCTCTGGGATCCCTTCCAGGTTT

AGCGGCAGTGGATCAGGGACAGATTTTACTCTTACCATCAACAGTGTGGAGTCTGAAGATAT

TGCAGATTATTACTGTCAACAAAGTGGGAGCTGGCCGTACACGTTCGGAGGGGGGACCAAG

CTGGAAATAAAAGGCGGATCTGAGGGAAAGTCCAGCGGCTCCGGCAGCGAAAGCAAGTCCA

CCGGCGGAAGCGAGGTGCAACTGGTGGAGTCTGGGGGAGGCCTGGTCAAGCCTGGGGGGTC

CCTGAGACTCTCCTGTGCAGCCTCTGGATTCACCTTCAGTAGATATAACATGAACTGGGTCC

GCCAGGCTCCAGGGAAGGGGCTGGAGTGGGTCTCATCCATTAGTACTAGTAGTAATTACATA

TACTACGCAGACTCAGTGAAGGGCCGATTCACCTTCTCCAGAGACAACGCCAAGAACTCACT

GGATCTGCAAATGAGCGGCCTGAGAGCCGAGGACACGGCTATTTATTACTGTACGAGAGGC

TGGGGGCCTTTTGACTACTGGGGCCAGGGAACCCTGGTCACCGTCTCCTCAGAGCCCAAATC

TAGCGACAAAACTCACACATGTCCACCGTGCCCAGCACCTGAAGCAGCAGGGGGACCGTCA

GTCTTCCTCTTCCCCCCAAAACCCAAGGACACCCTCATGATCTCCCGGACCCCTGAGGTCAC

ATGCGTGGTGGTGAGCGTGAGCCACGAAGACCCTGAGGTCAAGTTCAACTGGTACGTGGAC

GGCGTGGAGGTGCATAATGCCAAGACAAAGCCGCGGGAGGAGCAGTACAACAGCACGTAC

CGTGTGGTCAGCGTCCTCACCGTCCTGCACCAGGACTGGCTGAATGGCAAGGAGTACAAGTG

CAAGGTCTCCAACAAAGCCCTCCCAGCCCCCATCGAGAAAACCATCTCCAAAGCCAAAGGG

CAGCCCCGAGAACCACAGGTGTACGTGTACCCCCCATCCCGGGAGGAGATGACCAAGAACC

AGGTCAGCCTGACCTGCCTGGTCAAAGGCTTCTATCCCAGCGACATCGCCGTGGAGTGGGAG

AGCAATGGGCAGCCGGAGAACAACTACAAGACCACGCCTCCCGTGCTGGACTCCGACGGCT

CCTTCGCCCTCGTGAGCAAGCTCACCGTGGACAAGTCTAGATGGCAGCAGGGGAACGTCTTC

TCATGCTCCGTGATGCATGAGGCTCTGCACAACCACTACACGCAGAAGAGCCTCTCCCTGTC

TCCGGGTAAA

-continued (CD3W450_LH-scFv)

SEQ ID NO: 424

CAGTCTGCTCTGACCCAGCCTGCCTCCGTGTCTGGCTCTCCCGGCCAGTCCATCACCATCAGC

TGTACCGGCACCTCCTCCAACATCGGCACCTACAAGTTCGTGTCCTGGTATCAGCAGCACCC

CGGCAAGGCCCCCAAAGTGATGATCTACGAGGTGTCCAAGCGGCCCTCCGGCGTGTCCAAC

AGATTCTCCGGCTCCAAGTCCGGCAACACCGCCTCCCTGACAATCAGCGGACTGCAGGCCGA

GGACGAGGCCGACTACTACTGTGTGTCCTACGCCGGCTCTGGCACCCTGCTGTTTGGCGGCG

GAACAAAGCTGACCGTGCTGGGCGGCTCCGAGGGCAAGAGCAGCGGCAGCGGCAGCGAGA

GCAAGAGCACCGGCGGCAGCCAAGTGCAACTCCAACAAAGCGGCCCAGGGCTGGTAAAGCC

TTCACAGACCCTCTCACTTACTTGCGCAATATCTGGGGACTCCGTGTTTAATAACAATGCTGC

ATGGAGCTGGATTCGCCAGAGCCCAAGTCGCGGGCTCGAGTGGCTTGGTCGAACCTATTACC

GCTCCAAGTGGCTCTATGACTACGCAGTAAGCGTCAAATCACGGATAACAATCAACCCTGAC

ACATCCAAGAATCAGTTTAGTCTGCAACTCAACTCAGTCACCCCTGAGGATACCGCAGTGTA

TTATTGTGCCAGAGGGTACAGCTCTTCCTTTGATTACTGGGGCCAAGGTACACTGGTAACAG

TATCAAGC (CD3W450_LH-scFv-Fc)

SEQ ID NO: 436

CAGTCTGCTCTGACCCAGCCTGCCTCCGTGTCTGGCTCTCCCGGCCAGTCCATCACCATCAGC

TGTACCGGCACCTCCTCCAACATCGGCACCTACAAGTTCGTGTCCTGGTATCAGCAGCACCC

CGGCAAGGCCCCCAAAGTGATGATCTACGAGGTGTCCAAGCGGCCCTCCGGCGTGTCCAAC

AGATTCTCCGGCTCCAAGTCCGGCAACACCGCCTCCCTGACAATCAGCGGACTGCAGGCCGA

GGACGAGGCCGACTACTACTGTGTGTCCTACGCCGGCTCTGGCACCCTGCTGTTTGGCGGCG

GAACAAAGCTGACCGTGCTGGGCGGCTCCGAGGGCAAGAGCAGCGGCAGCGGCAGCGAGA

GCAAGAGCACCGGCGGCAGCCAAGTGCAACTCCAACAAAGCGGCCCAGGGCTGGTAAAGCC

TTCACAGACCCTCTCACTTACTTGCGCAATATCTGGGGACTCCGTGTTTAATAACAATGCTGC

ATGGAGCTGGATTCGCCAGAGCCCAAGTCGCGGGCTCGAGTGGCTTGGTCGAACCTATTACC

GCTCCAAGTGGCTCTATGACTACGCAGTAAGCGTCAAATCACGGATAACAATCAACCCTGAC

ACATCCAAGAATCAGTTTAGTCTGCAACTCAACTCAGTCACCCCTGAGGATACCGCAGTGTA

TTATTGTGCCAGAGGGTACAGCTCTTCCTTTGATTACTGGGGCCAAGGTACACTGGTAACAG

TATCAAGCGAGCCCAAATCTAGCGACAAAACTCACACATGTCCACCGTGCCCAGCACCTGA

AGCAGCAGGGGACCGTCAGTCTTCCTCTTCCCCCCAAAACCCAAGGACACCCTCATGATCT

CCCGGACCCCTGAGGTCACATGCGTGGTGGTGAGCGTGAGCCACGAAGACCCTGAGGTCAA

GTTCAACTGGTACGTGGACGGCGTGGAGGTGCATAATGCCAAGACAAAGCCGCGGGAGGAG

CAGTACAACAGCACGTACCGTGTGGTCAGCGTCCTCACCGTCCTGCACCAGGACTGGCTGAA

TGGCAAGGAGTACAAGTGCAAGGTCTCCAACAAAGCCCTCCCAGCCCCCATCGAGAAAACC

ATCTCCAAAGCCAAAGGGCAGCCCCGAGAACCACAGGTGTACGTGTACCCCCCATCCCGGG

AGGAGATGACCAAGAACCAGGTCAGCCTGACCTGCCTGGTCAAAGGCTTCTATCCCAGCGA

CATCGCCGTGGAGTGGGAGAGCAATGGGCAGCCGGAGAACAACTACAAGACCACGCCTCCC

GTGCTGGACTCCGACGGCTCCTTCGCCCTCGTGAGCAAGCTCACCGTGGACAAGTCTAGATG

GCAGCAGGGGAACGTCTTCTCATGCTCCGTGATGCATGAGGCTCTGCACAACCACTACACGC

AGAAGAGCCTCTCCCTGTCTCCGGGT

-continued (CD3B219_LH-scFv)
SEQ ID NO: 425

CAGACAGTGGTGACCCAGGAACCTAGCCTCACCGTGAGCCCCGGAGGAACCGTGACCCTGA

CCTGCAGAAGCAGCACCGGCGCCGTGACCACCAGCAACTACGCCAACTGGGTGCAGCAGAA

ACCTGGCCAGGCCCCTAGAGGCCTGATTGGCGGCACCAATAAGAGGGCCCCCGGAACCCCT

GCCAGGTTTAGCGGCAGCCTGCTGGGCGGCAAGGCTGCTCTGACCCTGTCCGGAGTGCAGCC

CGAGGATGAGGCCGAGTACTACTGCGCCCTGTGGTACAGCAACCTCTGGGTGTTCGGCGGCG

GCACAAAGCTGACCGTGCTCGGCGGCTCCGAGGGCAAGAGCAGCGGCAGCGGCAGCGAGA

GCAAGAGCACCGGCGGCAGCGAAGTGCAGCTGGTGGAGAGCGGAGGAGGACTGGTGCAGC

CCGGAGGAAGCCTGAGACTGAGCTGCGCCGCCAGCGGCTTTACCTTCAACACCTACGCCATG

AACTGGGTGAGACAGGCCCCCGGAAAGGGCCTGGAATGGGTCGCCAGGATCAGGTCCAAGT

ACAACAACTACGCCACCTACTACGCTGCCAGCGTGAAGGGCAGGTTCACCATCAGCAGGGA

CGACAGCAAGAACAGCCTGTACCTGCAGATGAACTCCCTGAAGACCGAGGACACCGCCGTG

TACTACTGCGTGAGGCACGGAAACTTCGGCAACAGCTACGTGAGCTGGTTCGCCTACTGGGG

CCAAGGCACACTGGTCACAGTGTCCAGC (CD3B219_LH-scFv-Fc)
SEQ ID NO: 437

CAGACAGTGGTGACCCAGGAACCTAGCCTCACCGTGAGCCCCGGAGGAACCGTGACCCTGA

CCTGCAGAAGCAGCACCGGCGCCGTGACCACCAGCAACTACGCCAACTGGGTGCAGCAGAA

ACCTGGCCAGGCCCCTAGAGGCCTGATTGGCGGCACCAATAAGAGGGCCCCCGGAACCCCT

GCCAGGTTTAGCGGCAGCCTGCTGGGCGGCAAGGCTGCTCTGACCCTGTCCGGAGTGCAGCC

CGAGGATGAGGCCGAGTACTACTGCGCCCTGTGGTACAGCAACCTCTGGGTGTTCGGCGGCG

GCACAAAGCTGACCGTGCTCGGCGGCTCCGAGGGCAAGAGCAGCGGCAGCGGCAGCGAGA

GCAAGAGCACCGGCGGCAGCGAAGTGCAGCTGGTGGAGAGCGGAGGAGGACTGGTGCAGC

CCGGAGGAAGCCTGAGACTGAGCTGCGCCGCCAGCGGCTTTACCTTCAACACCTACGCCATG

AACTGGGTGAGACAGGCCCCCGGAAAGGGCCTGGAATGGGTCGCCAGGATCAGGTCCAAGT

ACAACAACTACGCCACCTACTACGCTGCCAGCGTGAAGGGCAGGTTCACCATCAGCAGGGA

CGACAGCAAGAACAGCCTGTACCTGCAGATGAACTCCCTGAAGACCGAGGACACCGCCGTG

TACTACTGCGTGAGGCACGGAAACTTCGGCAACAGCTACGTGAGCTGGTTCGCCTACTGGGG

CCAAGGCACACTGGTCACAGTGTCCAGCGAGCCCAAATCTAGCGACAAAACTCACACATGT

CCACCGTGCCCAGCACCTGAAGCAGCAGGGGACCGTCAGTCTTCCTCTTCCCCCCAAAACC

CAAGGACACCCTCATGATCTCCCGGACCCCTGAGGTCACATGCGTGGTGGTGAGCGTGAGCC

ACGAAGACCCTGAGGTCAAGTTCAACTGGTACGTGGACGGCGTGGAGGTGCATAATGCCAA

GACAAAGCCGCGGGAGGAGCAGTACAACAGCACGTACCGTGTGGTCAGCGTCCTCACCGTC

CTGCACCAGGACTGGCTGAATGGCAAGGAGTACAAGTGCAAGGTCTCCAACAAAGCCCTCC

CAGCCCCCATCGAGAAAACCATCTCCAAAGCCAAAGGGCAGCCCCGAGAACCACAGGTGTA

CGTGTACCCCCCATCCCGGGAGGAGATGACCAAGAACCAGGTCAGCCTGACCTGCCTGGTC

AAAGGCTTCTATCCCAGCGACATCGCCGTGGAGTGGGAGAGCAATGGGCAGCCGGAGAACA

ACTACAAGACCACGCCTCCCGTGCTGGACTCCGACGGCTCCTTCGCCCTCGTGAGCAAGCTC

ACCGTGGACAAGTCTAGATGGCAGCAGGGGAACGTCTTCTCATGCTCCGTGATGCATGAGGC

TCTGCACAACCACTACACGCAGAAGAGCCTCTCCCTGTCTCCGGGT

Engineering of CD3 Fabs for HLA-G×CD3 Bispecific Generation

The CD3 specific VH and VL regions were engineered in VH-CH1-hinge-CH2-CH3 (Table 39) and VL-CL (Table 40) formats respectively and expressed as IgG1. The polypeptides of SEQ ID NOs: 158 or 493 comprising the Fc silencing mutation L234A/L235A/D265S and the CH3 mutation T350V/L351Y/F405A/Y407V designed to promote selective heterodimerization were used to generate the CD3 specific VH-CH1-hinge-CH2-CH3 (Table 39). B23B62 was used as an isotype control.

(huIgG1_G1m(17)_AAS_ZWA)
SEQ ID NO: 158
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

LNGKEYKCKVSNKALPAPIEKTISKAKGQPREPQVYVYPPSREEMTKNQ

VSLTCLVKGFYPSDIAVEWESNGQPENNYKTTPPVLDSDGSFALVSKLT

VDKSRWQQGNVFSCSVMHEALHNHYTQKSLSLSPGK

SEQ ID NO: 493
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

LNGKEYKCKVSNKALPAPIEKTISKAKGQPREPQVYVYPPSREEMTKNQ

VSLTCLVKGFYPSDIAVEWESNGQPENNYKTTPPVLDSDGSFALVSKLT

VDKSRWQQGNVFSCSVMHEALHNHYTQKSLSLSPG

DNA sequences of anti-CD3 molecules in VH-CH1-linker-CH2-CH3 format are shown in Table 41.

TABLE 39

Amino acid sequence of the anti CD3 antibody VH-CH1-hinge-CH2-CH3. heavy chain sequences of selected anti-CD3 antibodies

| HC protein | SEQ ID NO: | HC amino acid sequence |
| --- | --- | --- |
| CD3W244 HC, CD3W245 HC, CD3W246 HC, CD3W247 HC, CD3W248 HC | 438 | EVQLVESGGGLVKPGGSLRLSCAASGFTFSRYNMNWVRQAPGKGL EWVSSISTSSNYIYYADSVKGRFTFSRDNAKNSLDLQMSGLRAEDT AIYYCTRGWGPFDYWGQGTLVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKKVEPKSCDKTHTCPPCP APEAAGGPSVFLFPPKPKDTLMISRTPEVTCVVVSVSHEDPEVKFNW YVDGVEVHNAKTKPREEQYNSTYRVVSVLTVLHQDWLNGKEYKC KVSNKALPAPIEKTISKAKGQPREPQVYVYPPSREEMTKNQVSLTCL VKGFYPSDIAVEWESNGQPENNYKTTPPVLDSDGSFALVSKLTVDK SRWQQGNVFSCSVMHEALHNHYTQKSLSLSPGK |
| CD3W244 HC, CD3W245 HC, CD3W246 HC, CD3W247 HC, CD3W248 HC, no C-terminal Lys | 491 | EVQLVESGGGLVKPGGSLRLSCAASGFTFSRYNMNWVRQAPGKGL EWVSSISTSSNYIYYADSVKGRFTFSRDNAKNSLDLQMSGLRAEDT AIYYCTRGWGPFDYWGQGTLVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKKVEPKSCDKTHTCPPCP APEAAGGPSVFLFPPKPKDTLMISRTPEVTCVVVSVSHEDPEVKFNW YVDGVEVHNAKTKPREEQYNSTYRVVSVLTVLHQDWLNGKEYKC KVSNKALPAPIEKTISKAKGQPREPQVYVYPPSREEMTKNQVSLTCL VKGFYPSDIAVEWESNGQPENNYKTTPPVLDSDGSFALVSKLTVDK SRWQQGNVFSCSVMHEALHNHYTQKSLSLSPG |
| CD3B376 HC | 439 | QVQLQQSGPRLVRPSQTLSLTCAISGDSVFNNNAAWSWIRQSPSRG LEWLGRTYYRSKWLYDYAVSVKSRITVNPDTSRNQFTLQLNSVTPE DTALYYCARGYSSSFDYWGQGTLVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPPC PAPEAAGGPSVFLFPPKPKDTLMISRTPEVTCVVVSVSHEDPEVKFN WYVDGVEVHNAKTKPREEQYNSTYRVVSVLTVLHQDWLNGKEYK CKVSNKALPAPIEKTISKAKGQPREPQVYVYPPSREEMTKNQVSLTC LVKGFYPSDIAVEWESNGQPENNYKTTPPVLDSDGSFALVSKLTVD KSRWQQGNVFSCSVMHEALHNHYTQKSLSLSPGK |
| CD3B376 HC, no C-terminal Lys | 489 | QVQLQQSGPRLVRPSQTLSLTCAISGDSVFNNNAAWSWIRQSPSRG LEWLGRTYYRSKWLYDYAVSVKSRITVNPDTSRNQFTLQLNSVTPE DTALYYCARGYSSSFDYWGQGTLVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPPC PAPEAAGGPSVFLFPPKPKDTLMISRTPEVTCVVVSVSHEDPEVKFN WYVDGVEVHNAKTKPREEQYNSTYRVVSVLTVLHQDWLNGKEYK CKVSNKALPAPIEKTISKAKGQPREPQVYVYPPSREEMTKNQVSLTC LVKGFYPSDIAVEWESNGQPENNYKTTPPVLDSDGSFALVSKLTVD KSRWQQGNVFSCSVMHEALHNHYTQKSLSLSPG |

TABLE 39-continued

Amino acid sequence of the anti CD3 antibody VH-CH1-hinge-CH2-CH3. heavy chain sequences of selected anti-CD3 antibodies

| HC protein | SEQ ID NO: | HC amino acid sequence |
|---|---|---|
| CD3B450 HC | 440 | QVQLQQSGPGLVKPSQTLSLTCAISGDSVFNNNAAWSWIRQSPSRG LEWLGRTYYRSKWLYDYAVSVKSRITINPDTSKNQFSLQLNSVTPE DTAVYYCARGYSSSFDYWGQGTLVTVSS ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPE VTCVVVSVSHEDPEVKFNWYVDGVEVHNAKTKPREEQYNSTYRV VSVLTVLHQDWLNGKEYKCKVSNKALPAPIEKTISKAKGQPREPQV YVYPPSREEMTKNQVSLTCLVKGFYPSDIAVEWESNGQPENNYKTT PPVLDSDGSFALVSKLTVDKSRWQQGNVFSCSVMHEALHNHYTQK SLSLSPGK |
| CD3B219 | 441 | EVQLVESGGGLVQPGGSLRLSCAASGFTFNTYAMNWVRQAPGKGL EWVARIRSKYNNYATYYAASVKGRFTISRDDSKNSLYLQMNSLKT EDTAVYYCVRHGNFGNSYVSWFAYWGQGTLVTVSSASTKGPSVFP LAPSSKSTSGGTAALGCLVKDYFPEPVTVSWNSGALTSGVHTFPAV LQSSGLYSLSSVVTVPSSSLGTQTYICNVNHKPSNTKVDKKVEPKSC HCDKTHTCPPCPAPEAAGGPSVFLFPPKPKDTLMISRTPEVTCVVVSVS HEDPEVKFNWYVDGVEVHNAKTKPREEQYNSTYRVVSVLTVLHQ DWLNGKEYKCKVSNKALPAPIEKTISKAKGQPREPQVYVYPPSREE MTKNQVSLTCLVKGFYPSDIAVEWESNGQPENNYKTTPPVLDSDGS FALVSKLTVDKSRWQQGNVFSCSVMHEALHNHYTQKSLSLSPG |
| B23B62 HC | 482 | QITLKESGPTLVKPTQTLTLTCTFSGFSLSTSGMGVSWIRQPPGKALE WLAHIYWDDDKRYNPSLKSRLTITKDTSKNQVVLTMTNMDPVDTA TYYCARLYGFTYGFAYWGQGTLVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPPC PAPEAAGGPSVFLFPPKPKDTLMISRTPEVTCVVVSVSHEDPEVKFN WYVDGVEVHNAKTKPREEQYNSTYRVVSVLTVLHQDWLNGKEYK CKVSNKALPAPIEKTISKAKGQPREPQVYVYPPSREEMTKNQVSLTC LVKGFYPSDIAVEWESNGQPENNYKTTPPVLDSDGSFALVSKLTVD KSRWQQGNVFSCSVMHEALHNHYTQKSLSLSPG |

TABLE 40

Light chain amino acid sequences of selected anti-CD3 antibodies

| LC protein | SEQ ID NO: | LC amino acid sequence |
|---|---|---|
| CD3W244 LC | 442 | DIQMTQSPSSLSASVGDRVTITCRARQSIGTAIHWYQQKPGKAPKLL IYYASESISGVPSRFSGSGSGTDFTLTISSVQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W245 LC | 443 | DIQMTQSPSSLSASVGDRVTITCRARQSIGTAIHWYQQKPGKAPKLL IKYASESISGVPSRFSGSGSGTDFTLTISSLQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W246 LC | 444 | DIQMTQSPSSLSASVGDRVTITCRARQSIGTAIHWYQQKPGKAPKLL IKYASESISGVPSRFSGSGSGTDFTLTISSVQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W247 LC | 445 | DIQMTQSPSSLSASVGDRVTITCRARQSIGTAIHWYQQKPGKAPKLL IYYASESISGVPSRFSGSGSGTDFTLTISSLQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W248 LC | 446 | DILLTQSPGILSVSPGERVSFSCRARQSIGTAIHWYQQRTNGSPRLLIK YASESISGIPSRFSGSGSGTDFTLTINSVESEDIADYYCQQSGSWPYTF GGGTKLEIKRTVAAPSVFIFPPSDEQLKSGTASVVCLLNNFYPREAK VQWKVDNALQSGNSQESVTEQDSKDSTYSLSSTLTLSKADYEKHK VYACEVTHQGLSSPVTKSFNRGEC |

TABLE 40-continued

Light chain amino acid sequences of selected anti-CD3 antibodies

| LC protein | SEQ ID NO: | LC amino acid sequence |
|---|---|---|
| CD3B376 LC | 447 | QSALTQPASVSGSPGQSMSCTGTSSNIGTYKFVSWYQQHPDKAPK VLLYEVSKRPSGVSSRFSGSKSGNTASLTISGLQAEDQADYHCVSYA GSGTLLFGGGTKLTVLGQPKAAPSVTLFPPSSEELQANKATLVCLIS DFYPGAVTVAWKADSSPVKAGVETTTPSKQSNNKYAASSYLSLTPE QWKSHRSYSCQVTHEGSTVEKTVAPTECS |
| CD3B450 LC | 448 | QSALTQPASVSGSPGQSMSCTGTSSNIGTYKFVSWYQQHPGKAPK VMIYEVSKRPSGVSNRFSGSKSGNTASLTISGLQAEDEADYYCVSY AGSGTLLFGGGTKLTVLGQPKAAPSVTLFPPSSEELQANKATLVCLI SDFYPGAVTVAWKADSSPVKAGVETTTPSKQ SNNKYAASSYLSLTP EQWKSHRSYSCQVTHEGSTVEKTVAPTECS |
| CD3B219 LC | 449 | qtvvtqepsltvspggtvtltcrsstgavttsnyanwvqqkpgqaprgliggtnkrapgtparfsgsllggk aaltlsgvqpedeaeyycalwysnlwvfgggtkltvlgqpkaapsvtlfppsseelqankatlvclisdfy pgavtvawkadsspvkagvetttpskqsnnkyaassylsltpeqwkshrsyscqvthegstvektvapt ecs |
| B23B62 LC | 483 | divmtqspdslavslgeratincrasqsvdyngisymhwyqqkpgqppklliyaasnpesgvpdrfsg sgsgtdftltisslqaedvavyycqqiiedpwtfgqgtkveikrtvaapsvfifppsdeqlksgtasvvcll nnfypreakvqwkvdnalqsgnsqesvteqdskdstyslsstltlskadyekhkvyacevthqglsspv tksfnrgec |

| TABLE 41 | | |
|---|---|---|
| cDNA SEQ ID NOs of anti-CD3 antibodies HC in VH-CH1-hinge-CH2-C3 format and LC in VL-CL format. | | |
| Antibody | HC cDNA SEQ ID NO: | LC cDNA SEQ ID NO: |
| CD3W244 | 450 | 454 |
| CD3W245 | 450 | 455 |
| CD3W246 | 450 | 456 |
| CD3W247 | 450 | 457 |
| CD3W248 | 450 | 458 |
| CD3B376 | 451 or 499 | 459 |
| CD3B450 | 452 | 460 |
| CD3B219 | 453 | 461 |

(CD3W244, CDRW245, CD3W246, CD3W247, CD3W248 HC cDNA)
SEQ ID NO: 450
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGCCCAT

TCGACTACTGGGGCCAGGGCACCCTGGTGACCGTGAGCAGCGCCTCCACCAAGGGCCCATC

GGTCTTCCCCCTGGCACCCTCCTCCAAGAGCACCTCTGGGGGCACAGCGGCCCTGGGCTGCC

TGGTCAAGGACTACTTCCCCGAACCGGTGACGGTGTCGTGGAACTCAGGCGCCCTGACCAGC

GGCGTGCACACCTTCCCGGCTGTCCTACAGTCCTCAGGACTCTACTCCCTCAGCAGCGTGGT

GACCGTGCCCTCCAGCAGCTTGGGCACCCAGACCTACATCTGCAACGTGAATCACAAGCCCA

GCAACACCAAGGTGGACAAGAAAGTTGAGCCCAAATCTTGTGACAAAACTCACACATGTCC

ACCGTGCCCAGCACCTGAAGCAGCAGGGGGACCGTCAGTCTTCCTCTTCCCCCCAAAACCCA

AGGACACCCTCATGATCTCCCGGACCCCTGAGGTCACATGCGTGGTGGTGAGCGTGAGCCAC

GAAGACCCTGAGGTCAAGTTCAACTGGTACGTGGACGGCGTGGAGGTGCATAATGCCAAGA

CAAAGCCGCGGGAGGAGCAGTACAACAGCACGTACCGTGTGGTCAGCGTCCTCACCGTCCT

GCACCAGGACTGGCTGAATGGCAAGGAGTACAAGTGCAAGGTCTCCAACAAAGCCCTCCCA

-continued

GCCCCCATCGAGAAAACCATCTCCAAAGCCAAAGGGCAGCCCCGAGAACCACAGGTGTACG

TGTACCCCCATCCCGGGAGGAGATGACCAAGAACCAGGTCAGCCTGACCTGCCTGGTCAA

AGGCTTCTATCCCAGCGACATCGCCGTGGAGTGGGAGAGCAATGGGCAGCCGGAGAACAAC

TACAAGACCACGCCTCCCGTGCTGGACTCCGACGGCTCCTTCGCCCTCGTGAGCAAGCTCAC

CGTGGACAAGTCTAGATGGCAGCAGGGGAACGTCTTCTCATGCTCCGTGATGCATGAGGCTC

TGCACAACCACTACACGCAGAAGAGCCTCTCCCTGTCTCCGGGTAAA (CD3W244 LC cDNA)

SEQ ID NO: 454

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT (CD3W245 LC cDNA)

SEQ ID NO: 455

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT (CD3W246 LC cDNA)

SEQ ID NO: 456

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

-continued

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT (CD3W247 LC cDNA)
SEQ ID NO: 457

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT (CD3W248 LC cDNA)
SEQ ID NO: 458

GACATCTTGCTGACTCAGTCTCCAGGCATCCTGTCTGTGAGTCCAGGAGAAAGAGTCAGTTT

CTCCTGCAGGGCCAGACAGAGCATTGGCACAGCCATACACTGGTATCAGCAAAGAACAAAT

GGTTCTCCAAGGCTTCTCATAAAGTATGCTTCTGAGTCTATCTCTGGGATCCCTTCCAGGTTT

AGCGGCAGTGGATCAGGGACAGATTTTACTCTTACCATCAACAGTGTGGAGTCTGAAGATAT

TGCAGATTATTACTGTCAACAAAGTGGGAGCTGGCCGTACACGTTCGGAGGGGGGACCAAG

CTGGAAATAAAACGTACGGTGGCTGCACCATCTGTCTTCATCTTCCCGCCATCTGATGAGCA

GTTGAAATCTGGAACTGCCTCTGTTGTGTGCCTGCTGAATAACTTCTATCCCAGAGAGGCCA

AAGTACAGTGGAAGGTGGATAACGCCCTCCAATCGGGTAACTCCCAGGAGAGTGTCACAGA

GCAGGACAGCAAGGACAGCACCTACAGCCTCAGCAGCACCCTGACGCTGAGCAAAGCAGAC

TACGAGAAACACAAAGTCTACGCCTGCGAAGTCACCCATCAGGGCCTGAGCTCGCCCGTCA

CAAAGAGCTTCAACAGGGGAGAGTGT (CD3B376 HC cDNA)
SEQ ID NO: 451

CAGGTGCAGCTCCAACAGAGTGGTCCCAGACTCGTGAGACCCTCTCAAACACTCAGTTTGAC

TTGTGCCATCTCAGGCGATTCAGTTTTCAACAACAATGCAGCTTGGAGCTGGATTAGGCAGT

CACCTAGTCGCGGTCTTGAATGGCTTGGGCGTACATACTATCGCTCTAAATGGTTGTATGATT

ACGCTGTGTCCGTGAAGAGCCGAATCACCGTAAACCCTGATACCTCCAGGAATCAGTTCACA

TTGCAACTGAATAGTGTGACTCCCGAGGATACTGCACTCTATTATTGTGCCCGAGGATATAG

CAGTAGCTTCGACTATTGGGGACAAGGGACACTCGTTACCGTTAGTTCAGCCTCCACCAAGG

GCCCATCGGTCTTCCCCCTGGCACCCTCCTCCAAGAGCACCTCTGGGGGCACAGCGGCCCTG

GGCTGCCTGGTCAAGGACTACTTCCCCGAACCGGTGACGGTGTCGTGGAACTCAGGCGCCCT

GACCAGCGGCGTGCACACCTTCCCGGCTGTCCTACAGTCCTCAGGACTCTACTCCCTCAGCA

GCGTGGTGACCGTGCCCTCCAGCAGCTTGGGCACCCAGACCTACATCTGCAACGTGAATCAC

AAGCCCAGCAACACCAAGGTGGACAAGAAAGTTGAGCCCAAATCTTGTGACAAAACTCACA

CATGTCCACCGTGCCCAGCACCTGAAGCAGCAGGGGACCGTCAGTCTTCCTCTTCCCCCCA

AAACCCAAGGACACCCTCATGATCTCCCGGACCCCTGAGGTCACATGCGTGGTGGTGAGCGT

-continued

GAGCCACGAAGACCCTGAGGTCAAGTTCAACTGGTACGTGGACGGCGTGGAGGTGCATAAT

GCCAAGACAAAGCCGCGGGAGGAGCAGTACAACAGCACGTACCGTGTGGTCAGCGTCCTCA

CCGTCCTGCACCAGGACTGGCTGAATGGCAAGGAGTACAAGTGCAAGGTCTCCAACAAAGC

CCTCCCAGCCCCCATCGAGAAAACCATCTCCAAAGCCAAAGGGCAGCCCCGAGAACCACAG

GTGTACGTGTACCCCCCATCCCGGGAGGAGATGACCAAGAACCAGGTCAGCCTGACCTGCCT

GGTCAAAGGCTTCTATCCCAGCGACATCGCCGTGGAGTGGGAGAGCAATGGGCAGCCGGAG

AACAACTACAAGACCACGCCTCCCGTGCTGGACTCCGACGGCTCCTTCGCCCTCGTGAGCAA

GCTCACCGTGGACAAGTCTAGATGGCAGCAGGGGAACGTCTTCTCATGCTCCGTGATGCATG

AGGCTCTGCACAACCACTACACGCAGAAGAGCCTCTCCCTGTCTCCGGGTAAA (CD3B376 HC cDNA)

SEQ ID NO: 499

CAGGTGCAGCTCCAACAGAGTGGTCCCAGACTCGTGAGACCCTCTCAAACACTCAGTTTGAC

TTGTGCCATCTCAGGCGATTCAGTTTTCAACAACAATGCAGCTTGGAGCTGGATTAGGCAGT

CACCTAGTCGCGGTCTTGAATGGCTTGGGCGTACATACTATCGCTCTAAATGGTTGTATGATT

ACGCTGTGTCCGTGAAGAGCCGAATCACCGTAAACCCTGATACCTCCAGGAATCAGTTCACA

TTGCAACTGAATAGTGTGACTCCCGAGGATACTGCACTCTATTATTGTGCCCGAGGATATAG

CAGTAGCTTCGACTATTGGGGACAAGGGACACTCGTTACCGTTAGTTCAGCCTCCACCAAGG

GCCCATCGGTCTTCCCCCTGGCACCCTCCTCCAAGAGCACCTCTGGGGGCACAGCGGCCCTG

GGCTGCCTGGTCAAGGACTACTTCCCCGAACCGGTGACGGTGTCGTGGAACTCAGGCGCCCT

GACCAGCGGCGTGCACACCTTCCCGGCTGTCCTACAGTCCTCAGGACTCTACTCCCTCAGCA

GCGTGGTGACCGTGCCCTCCAGCAGCTTGGGCACCCAGACCTACATCTGCAACGTGAATCAC

AAGCCCAGCAACACCAAGGTGGACAAGAAAGTTGAGCCCAAATCTTGTGACAAAACTCACA

CATGTCCACCGTGCCCAGCACCTGAAGCAGCAGGGGACCGTCAGTCTTCCTCTTCCCCCCA

AAACCCAAGGACACCCTCATGATCTCCCGGACCCCTGAGGTCACATGCGTGGTGGTGAGCGT

GAGCCACGAAGACCCTGAGGTCAAGTTCAACTGGTACGTGGACGGCGTGGAGGTGCATAAT

GCCAAGACAAAGCCGCGGGAGGAGCAGTACAACAGCACGTACCGTGTGGTCAGCGTCCTCA

CCGTCCTGCACCAGGACTGGCTGAATGGCAAGGAGTACAAGTGCAAGGTCTCCAACAAAGC

CCTCCCAGCCCCCATCGAGAAAACCATCTCCAAAGCCAAAGGGCAGCCCCGAGAACCACAG

GTGTACGTGTACCCCCCATCCCGGGAGGAGATGACCAAGAACCAGGTCAGCCTGACCTGCCT

GGTCAAAGGCTTCTATCCCAGCGACATCGCCGTGGAGTGGGAGAGCAATGGGCAGCCGGAG

AACAACTACAAGACCACGCCTCCCGTGCTGGACTCCGACGGCTCCTTCGCCCTCGTGAGCAA

GCTCACCGTGGACAAGTCTAGATGGCAGCAGGGGAACGTCTTCTCATGCTCCGTGATGCATG

AGGCTCTGCACAACCACTACACGCAGAAGAGCCTCTCCCTGTCTCCGGGT (CD3B376 LC cDNA)

SEQ ID NO: 459

CAGTCTGCTCTGACCCAGCCTGCCTCCGTGTCTGGCTCTCCCGGCCAGTCCATCACCATCAGC

TGTACCGGCACCTCCTCCAACATCGGCACCTACAAGTTCGTGTCCTGGTATCAGCAGCACCC

CGACAAGGCCCCCAAAGTGCTGCTGTACGAGGTGTCCAAGCGGCCCTCTGGCGTGTCCTCCA

GATTCTCCGGCTCCAAGTCTGGCAACACCGCCTCCCTGACCATCAGCGGACTGCAGGCTGAG

GACCAGGCCGACTACCACTGTGTGTCCTACGCTGGCTCTGGCACCCTGCTGTTTGGCGGAGG

CACCAAGCTGACCGTGCTGGGTCAGCCCAAGGCTGCACCCAGTGTCACTCTGTTCCCGCCCT

CCTCTGAGGAGCTTCAAGCCAACAAGGCCACACTGGTGTGTCTCATAAGTGACTTCTACCCG

-continued

GGAGCCGTGACAGTGGCCTGGAAGGCCGATAGCAGCCCCGTCAAGGCGGGAGTGGAGACCA

CCACACCCTCCAAACAAAGCAACAACAAGTACGCGGCCAGCAGCTATCTGAGCCTGACGCC

TGAGCAGTGGAAGTCCCACAGAAGCTACAGCTGCCAGGTCACGCATGAAGGGAGCACCGTG

GAGAAGACAGTGGCCCCTACAGAATGTTCA (CD3B450 HC cDNA)

SEQ ID NO: 452

CAAGTGCAACTCCAACAAAGCGGCCCAGGGCTGGTAAAGCCTTCACAGACCCTCTCACTTAC

TTGCGCAATATCTGGGGACTCCGTGTTTAATAACAATGCTGCATGGAGCTGGATTCGCCAGA

GCCCAAGTCGCGGGCTCGAGTGGCTTGGTCGAACCTATTACCGCTCCAAGTGGCTCTATGAC

TACGCAGTAAGCGTCAAATCACGGATAACAATCAACCCTGACACATCCAAGAATCAGTTTA

GTCTGCAACTCAACTCAGTCACCCCTGAGGATACCGCAGTGTATTATTGTGCCAGAGGGTAC

AGCTCTTCCTTTGATTACTGGGGCCAAGGTACACTGGTAACAGTATCAAGC

GCCTCCACCAAGGGCCCATCGGTCTTCCCCCTGGCACCCTCCTCCAAGAGCACCTCTGGGGG

CACAGCGGCCCTGGGCTGCCTGGTCAAGGACTACTTCCCCGAACCGGTGACGGTGTCGTGGA

ACTCAGGCGCCCTGACCAGCGGCGTGCACACCTTCCCGGCTGTCCTACAGTCCTCAGGACTC

TACTCCCTCAGCAGCGTGGTGACCGTGCCCTCCAGCAGCTTGGGCACCCAGACCTACATCTG

CAACGTGAATCACAAGCCCAGCAACACCAAGGTGGACAAGAAAGTTGAGCCCAAATCTTGT

GACAAAACTCACACATGTCCACCGTGCCCAGCACCTGAAGCAGCAGGGGGACCGTCAGTCT

TCCTCTTCCCCCCAAAACCCAAGGACACCCTCATGATCTCCCGGACCCCTGAGGTCACATGC

GTGGTGGTGAGCGTGAGCCACGAAGACCCTGAGGTCAAGTTCAACTGGTACGTGGACGGCG

TGGAGGTGCATAATGCCAAGACAAAGCCGCGGGAGGAGCAGTACAACAGCACGTACCGTGT

GGTCAGCGTCCTCACCGTCCTGCACCAGGACTGGCTGAATGGCAAGGAGTACAAGTGCAAG

GTCTCCAACAAAGCCCTCCCAGCCCCCATCGAGAAAACCATCTCCAAAGCCAAAGGGCAGC

CCCGAGAACCACAGGTGTACGTGTACCCCCCATCCCGGGAGGAGATGACCAAGAACCAGGT

CAGCCTGACCTGCCTGGTCAAAGGCTTCTATCCCAGCGACATCGCCGTGGAGTGGGAGAGCA

ATGGGCAGCCGGAGAACAACTACAAGACCACGCCTCCCGTGCTGGACTCCGACGGCTCCTTC

GCCCTCGTGAGCAAGCTCACCGTGGACAAGTCTAGATGGCAGCAGGGGAACGTCTTCTCATG

CTCCGTGATGCATGAGGCTCTGCACAACCACTACACGCAGAAGAGCCTCTCCCTGTCTCCGG

GTAAA (CD3B450 LC cDNA)

SEQ ID NO: 460

CAGTCTGCTCTGACCCAGCCTGCCTCCGTGTCTGGCTCTCCCGGCCAGTCCATCACCATCAGC

TGTACCGGCACCTCCTCCAACATCGGCACCTACAAGTTCGTGTCCTGGTATCAGCAGCACCC

CGGCAAGGCCCCCAAAGTGATGATCTACGAGGTGTCCAAGCGGCCCTCCGGCGTGTCCAAC

AGATTCTCCGGCTCCAAGTCCGGCAACACCGCCTCCCTGACAATCAGCGGACTGCAGGCCGA

GGACGAGGCCGACTACTACTGTGTGTCCTACGCCGGCTCTGGCACCCTGCTGTTTGGCGGCG

GAACAAAGCTGACCGTGCTGGGTCAGCCCAAGGCTGCACCCAGTGTCACTCTGTTCCCGCCC

TCCTCTGAGGAGCTTCAAGCCAACAAGGCCACACTGGTGTGTCTCATAAGTGACTTCTACCC

GGGAGCCGTGACAGTGGCCTGGAAGGCCGATAGCAGCCCCGTCAAGGCGGGAGTGGAGACC

ACCACACCCTCCAAACAAAGCAACAACAAGTACGCGGCCAGCAGCTATCTGAGCCTGACGC

```
CTGAGCAGTGGAAGTCCCACAGAAGCTACAGCTGCCAGGTCACGCATGAAGGGAGCACCGT

GGAGAAGACAGTGGCCCCTACAGAATGTTCA
```

(CD3B219 HC cDNA)

SEQ ID NO: 453
```
GAAGTGCAGCTGGTGGAGAGCGGAGGAGGACTGGTGCAGCCCGGAGGAAGCCTGAGACTG

AGCTGCGCCGCCAGCGGCTTTACCTTCAACACCTACGCCATGAACTGGGTGAGACAGGCCCC

CGGAAAGGGCCTGGAATGGGTCGCCAGGATCAGGTCCAAGTACAACAACTACGCCACCTAC

TACGCTGCCAGCGTGAAGGGCAGGTTCACCATCAGCAGGGACGACAGCAAGAACAGCCTGT

ACCTGCAGATGAACTCCCTGAAGACCGAGGACACCGCCGTGTACTACTGCGTGAGGCACGG

AAACTTCGGCAACAGCTACGTGAGCTGGTTCGCCTACTGGGGCCAAGGCACACTGGTCACA

GTGTCCAGCGCCTCCACCAAGGGCCCATCGGTCTTCCCCCTGGCACCCTCCTCCAAGAGCAC

CTCTGGGGGCACAGCGGCCCTGGGCTGCCTGGTCAAGGACTACTTCCCCGAACCGGTGACGG

TGTCGTGGAACTCAGGCGCCCTGACCAGCGGCGTGCACACCTTCCCGGCTGTCCTACAGTCC

TCAGGACTCTACTCCCTCAGCAGCGTGGTGACCGTGCCCTCCAGCAGCTTGGGCACCCAGAC

CTACATCTGCAACGTGAATCACAAGCCCAGCAACACCAAGGTGGACAAGAAAGTTGAGCCC

AAATCTTGTGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGT
```

(CD3B219 LC cDNA)

SEQ ID NO: 461
```
CAGACCGTCGTGACCCAGGAACCTAGCCTGACCGTGTCTCCTGGCGGCACCGTGACCCTGAC

CTGCAGATCTTCTACAGGCGCCGTGACCACCAGCAACTACGCCAACTGGGTGCAGCAGAAG

CCAGGCCAGGCTCCCAGAGGACTGATCGGCGGCACCAACAAGAGAGCCCCTGGCACCCCTG

CCAGATTCAGCGGATCTCTGCTGGGAGGAAAGGCCGCCCTGACACTGTCTGGCGTGCAGCCT

GAAGATGAGGCCGAGTACTACTGCGCCCTGTGGTACAGCAACCTGTGGGTGTTCGGCGGAG

GCACCAAGCTGACAGTGCTGGGTCAGCCCAAGGCTGCACCCAGTGTCACTCTGTTCCCGCCC

TCCTCTGAGGAGCTTCAAGCCAACAAGGCCACACTGGTGTGTCTCATAAGTGACTTCTACCC

GGGAGCCGTGACAGTGGCCTGGAAGGCCGATAGCAGCCCCGTCAAGGCGGGAGTGGAGACC

ACCACACCCTCCAAACAAAGCAACAACAAGTACGCGGCCAGCAGCTATCTGAGCCTGACGC

CTGAGCAGTGGAAGTCCCACAGAAGCTACAGCTGCCAGGTCACGCATGAAGGGAGCACCGT

GGAGAAGACAGTGGCCCCTACAGAATGTTCA
```

Engineering of HLA-G Fab-Fc for HLA-G/CD3 Bispecific Generation

The HLA-G specific VH and VL regions were engineered in VH-CH1-hinge-CH2-CH3 and VL-CL formats respectively. The polypeptides of SEQ ID NOs: 462 or 494 comprising the Fc silencing mutations L234A/L235A/D265S and the CH3 mutations T350V/T366L/K392L/T394W designed to promote selective heterodimerization was used to generate the HLA-G specific VH-CH1-hinge-CH2-CH3.

```
(huIgG1_G1m(17)_AAS_ZWB)
                                          SEQ ID NO: 462
ASTKGPSVFPLAPSSKSTSGGTAALGCLVKDYFPEPVTVSWNSGALTSG
VHTFPAVLQSSGLYSLSSVVTVPSSSLGTQTYICNVNHKPSNTKVDKKV
EPKSCDKTHTCPPCPAPEAAGGPSVFLFPPKPKDTLMISRTPEVTCVVV
SVSHEDPEVKFNWYVDGVEVHNAKTKPREEQYNSTYRVVSVLTVLHQDW
LNGKEYKCKVSNKALPAPIEKTISKAKGQPREPQVYVLPPSREEMTKNQ
VSLLCLVKGFYPSDIAVEWESNGQPENNYLTWPPVLDSDGSFFLYSKLT
VDKSRWQQGNVFSCSVMHEALHNHYTQKSLSLSPGK

SEQ ID NO: 494
ASTKGPSVFPLAPSSKSTSGGTAALGCLVKDYFPEPVTVSWNSGALTSG
VHTFPAVLQSSGLYSLSSVVTVPSSSLGTQTYICNVNHKPSNTKVDKKV
EPKSCDKTHTCPPCPAPEAAGGPSVFLFPPKPKDTLMISRTPEVTCVVV
SVSHEDPEVKFNWYVDGVEVHNAKTKPREEQYNSTYRVVSVLTVLHQDW
LNGKEYKCKVSNKALPAPIEKTISKAKGQPREPQVYVLPPSREEMTKNQ
VSLLCLVKGFYPSDIAVEWESNGQPENNYLTWPPVLDSDGSFFLYSKLT
VDKSRWQQGNVFSCSVMHEALHNHYTQKSLSLSPG
```

The polypeptides of SEQ ID NO: 463 or 464 were used to generate the HLA-G specific VL-CL.

```
(human kappa light chain)
                                          SEQ ID NO: 463
RTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPV
TKSFNRGEC (human lambda light chain)
                                          SEQ ID NO: 464
GQPKAAPSVTLFPPSSEELQANKATLVCLISDFYPGAVTVAWKADSSPV
KAGVETTTPSKQSNNKYAASSYLSLTPEQWKSHRSYSCQVTHEGSTVEK
TVAPTECS
```

The amino acid sequences of HLA-G Fab-Fc HC and LC are shown in Tables 42 and 43, respectively. The cDNA SEQ ID Nos of HLA-G Fab-Fc HC and LC are listed in Table 44.

Table 42 Shows the Amino Acid Sequences of Anti-HLA-G Fab-Fc Heavy Chains (HCs).

| Fab-Fc Heavy chain | SEQ ID NO: | Amino acid sequence |
| --- | --- | --- |
| MHGB732-Fab-Fc HC | 465 | QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG |
| MHGB738-Fab-Fc HC | 466 | QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG |
| MHGB712-Fab-Fc HC | 467 | QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVF SCSVMHEALHNHYTQKSLSLSPG |

Table 43 Shows the Amino Acid Sequences of Anti-HLA-G Fab-Fc Light Chains (LCs).

| Fab-Fc Light chain | SEQ ID NO: | Amino acid sequence |
|---|---|---|
| MHGB732-Fab-Fc LC | 468 | DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| MHGB738-Fab-Fc LC | 469 | DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| MHGB712-Fab-Fc LC | 470 | DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

Table 44 Shows the cDNA Sequences of Anti-HLA-G Fab-Fc Light Chains (LCs) and Heavy Chains (HCs).

| Fab-Fc | SEQ ID NO: | cDNA sequence |
|---|---|---|
| MHGB732-Fab-Fc HC | 471 | CAAGTACAACTGCAACAAAGTGGTCCTGGGCTCGTGAAGCCTTCCCAGACTCTCAGCCTCACATGCGCTATAAGTGGGGATTCTGTTTCCTCAAATTCAGCAGCCTGGAATTGGATACGACAGTCTCCATCCCGTGGCCTTGAGTGGCTTGGTAGAACTTATTACCGATCCAAGTGGTACAATGATTACGCCGTTTCAGTGAAGTCCCGCATTACTATTAATCCCGACACATCTAAGAATCAAATTTCATTGCAACTGAATAGCGTAACACCCGAAGATACAGCAGTTTATTATTGTGCAGGTGATCGACGCTACGGCATAGTGGGACTTCCTTTCGCCTATTGGGGCCAAGGGACACTGGTCACTGTGTCATCCGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGTCCACCGTGCCCAGCACCTGAAGCAGCAGGGGACCGTCAGTCTTCCTCTTCCCCCCAAAACCCAAGGACACCCTCATGATCTCCCGGACCCCTGAGGTCACATGCGTGGTGGTGAGCGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACGTGCTGCCCCCATCCCGGGAGGAGATGACCAAGAACCAGGTCAGCCTGCTGTGCCTGGTCAAAGGCTTCTATCCCAGCGACATCGCCGTGGAGTGGGAGAGCAATGGGCAGCCGGAGAACAACTACCTCACCTGGCCTCCCGTGCTGGACTCCGACGGCTCCTTCTTCCTCTACAGCAAGCTCACCGTGGACAAGTCTAGATGGCAGCAGGGGAACGTCTTCTCATGCTCCGTGATGCATGAGGCTCTGCACAACCACTACACGCAGAAGAGCCTCTCCCTGTCTCCGGGT |
| MHGB732-Fab-Fc LC | 472 | GACATCGTAATGACACAGTCACCAGATTCATTGGCAGTTAGTCTGGGTGAAAGGGCAACAATCAACTGCAAGTCTTCTCAGAGTGTACTGCATAGTTCTAACAATAAGAACTACCTTACCTGGTTTCAACAGAAACCAGGTCAGCCCCCAAGTTGCTGATTTACTGGGCAAGCACCCGCGAATCCGGCGTTCCCGATCGATTTTCAGGTTCCGGGAGTGGGACCGACTTTACCTTGACCATCTCTTCCTTGCAGGCCGAAGATGTAGCCGTCTATTACTGCCATCAGTATTACTCTACTCCCCCCACATTCGGTCAAGGTACAAAAGTTGAGATAAAACGGACAGTGGCCGCTCCTTCCGTGTTCATCTTCCCACCTTCCGACGAGCAGCTGAAGTCCGGCACAGCTTCTGTCGTGTGTGCCTGCTGAACAACTTCTACCCTCGGGAAGCCAAGGTGCAGTGGAAGGTGGACAATGCCCTGCAGTCCGGCAACTCCCAAGAGTCTGTGACCGAGCAGGACTCCAAGGACAGCACCTACAGCCTGTCCTCCACACTGACCCTGTCCAAGGCCGACTACGAGAAGCACAAGGTGTACGCCTGCGAAGTGACCCATCAGGGCCTGTCTAGCCCTGTGACCAAGTCTTTCAACCGGGGCGAGTGT |
| MHGB738-Fab-Fc HC | 473 | CAGGTGCAGCTTCAACAGAGCGGACCTGGTCTGGTTAAGCCTTCCCAAACCCTGAGCCTGACTTGTGCTATTTCCGGGGATAGTGTTAGCTCCAATAGGGCAGCATGGAACTGGATCAGACAGTCCCCAAGCCGTGGACTTGAGTGGCTTGGACGTACTTATTACAGGAGTAAATGGTACAATGATTATGCCGTTTCTGTGAAGAGCCGTATTACTATAAACCCAGATACTTCTAAAAATCAAATTTCCCTTCAGCTCAACTCAGTTACACCAGAGGATACTGCAGTCTATTATTGCGCAAGAGTTCGACCTGGCATTCCCTTCGATTATTGGGGGCAGGGGACACCCGTTACTGTGTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGT |

| Fab-Fc | SEQ ID NO: | cDNA sequence |
|---|---|---|
| | | GAATCACAAGCCCAGCAACACCAAGGTGGACAAGAAAGTTGAGCCCAAATC<br>TTGTGACAAAACTCACACATGTCCACCGTGCCCAGCACCTGAAGCAGCAGG<br>GGGACCGTCAGTCTTCCTCTTCCCCCCAAAACCCAAGGACACCCTCATGATC<br>TCCCGGACCCCTGAGGTCACATGCGTGGTGGTGAGCGTGAGCCACGAAGA<br>CCCTGAGGTCAAGTTCAACTGGTACGTGGACGGCGTGGAGGTGCATAATGC<br>CAAGACAAAGCCGCGGGAGGAGCAGTACAACAGCACGTACCGTGTGGTCA<br>GCGTCCTCACCGTCCTGCACCAGGACTGGCTGAATGGCAAGGAGTACAAGT<br>GCAAGGTCTCCAACAAAGCCCTCCCAGCCCCCATCGAGAAAACCATCTCCA<br>AAGCCAAAGGGCAGCCCCGAGAACCACAGGTGTACGTGCTGCCCCCATCC<br>CGGGAGGAGATGACCAAGAACCAGGTCAGCCTGCTGTGCCTGGTCAAAGG<br>CTTCTATCCCAGCGACATCGCCGTGGAGTGGGAGAGCAATGGGCAGCCGG<br>AGAACAACTACCTCACCTGGCCTCCCGTGCTGGACTCCGACGGCTCCTTCT<br>TCCTCTACAGCAAGCTCACCGTGGACAAGTCTAGATGGCAGCAGGGGAACG<br>TCTTCTCATGCTCCGTGATGCATGAGGCTCTGCACAACCACTACACGCAGAA<br>GAGCCTCTCCCTGTCTCCGGGT |
| MHGB738-<br>Fab-Fc LC | 474 | GATATTGTTATGACACAGTCCCCAGATTCATTGGCAGTAAGCCTCGGTGAACGGGCTAC<br>TATTAACTGTAAGTCTTCCCAGAGTGTATTGTTCTCTTCAAATAACAAAAACTACCTGGC<br>ATGGTATCAGCAAAAGCCTGGTCAACCCCCTAAACTTCTCATATACTGGGCATCCACTC<br>GGGAGAGCGGTGTGCCAGACCGTTTCTCAGGGAGTGTGTCAGGTACAGATTTTACACT<br>CACAATTTCCAGCCTCCAAGCCGAAGACGTTGCAGTATATTATTGCCAACAATATCACTC<br>TACACCTTGGACATTTGGTCAAGGTACTAAAGTCGAAATCAAACGGACAGTGGCCGCT<br>CCTTCCGTGTTCATCTTCCCACCTTCCGACGAGCAGCTGAAGTCCGGCACAGCTTCTGTC<br>GTGTGCCTGCTGAACAACTTCTACCCTCGGGAAGCCAAGGTGCAGTGGAAGGTGGACA<br>ATGCCCTGCAGTCCGGCAACTCCCAAGAGTCTGTGACCGAGCAGGACTCCAAGGACAG<br>CACCTACAGCCTGTCCTCCACACTGACCCTGTCCAAGGCCGACTACGAGAAGCACAAG<br>GTGTACGCCTGCGAAGTGACCCATCAGGGCCTGTCTAGCCCTGTGACCAAGTCTTTCAA<br>CCGGGGCGAGTGT |
| MHGB712-<br>Fab-Fc HC | 475 | CAGGTGCAGCTTCAACAGAGCGGACCTGGTCTGGTTAAGCCTTCCCAAACCCTGAGCCT<br>GACTTGTGCTATTTCCGGGGATAGTGTTAGCTCCAATAGGGCAGCATGGAACTGGATC<br>AGACAGTCCCCAAGCCGTGGACTTGAGTGGCTTGGACGTACTTATTACAGGAGTAAAT<br>GGTACAATGATTATGCCGTTTCTGTGAAGAGCCGTATTACTATAAACCCAGATACTTCT<br>AAAAATCAAATTTCCCTTCAGCTCAACTCAGTTACACCAGAGGATACTGCAGTCTATTAT<br>TGCGCAAGAGTTCGACCTGGCATTCCCTTCGATTATTGGGGCAGGGGACACCCGTTA<br>CTGTGTCCTCAGCCTCCACCAAGGGCCCATCGGTCTTCCCCCTGGCACCCTCCTCCAAGA<br>GCACCTCTGGGGCACAGCGGCCCTGGGCTGCCTGGTCAAGGACTACTTCCCCGAACC<br>GGTGACGGTGTCGTGGAACTCAGGCGCCCTGACCAGCGGCGTGCACACCTTCCCGGCT<br>GTCCTACAGTCCTCAGGACTCTACTCCCTCAGCAGCGTGGTGACCGTGCCCTCCAGCAG<br>CTTGGGCACCCAGACCTACATCTGCAACGTGAATCACAAGCCCAGCAACACCAAGGTG<br>GACAAGAAAGTTGAGCCCAAATCTTGTGACAAAACTCACACATGTCCACCGTGCCCAG<br>CACCTGAAGCAGCAGGGGGACCGTCAGTCTTCCTCTTCCCCCCAAAACCCAAGGACACC<br>CTCATGATCTCCCGGACCCCTGAGGTCACATGCGTGGTGGTGAGCGTGAGCCACGAAG<br>ACCCTGAGGTCAAGTTCAACTGGTACGTGGACGGCGTGGAGGTGCATAATGCCAAGAC<br>AAAGCCGCGGGAGGAGCAGTACAACAGCACGTACCGTGTGGTCAGCGTCCTCACCGTC<br>CTGCACCAGGACTGGCTGAATGGCAAGGAGTACAAGTGCAAGGTCTCCAACAAAGCCC<br>TCCCAGCCCCCATCGAGAAAACCATCTCCAAAGCCAAAGGGCAGCCCCGAGAACCACA<br>GGTGTACGTGCTGCCCCCATCCCGGGAGGAGATGACCAAGAACCAGGTCAGCCTGCTG<br>TGCCTGGTCAAAGGCTTCTATCCCAGCGACATCGCCGTGGAGTGGGAGAGCAATGGGC<br>AGCCGGAGAACAACTACCTCACCTGGCCTCCCGTGCTGGACTCCGACGGCTCCTTCTTC<br>CTCTACAGCAAGCTCACCGTGGACAAGTCTAGATGGCAGCAGGGGAACGTCTTCTCAT<br>GCTCCGTGATGCATGAGGCTCTGCACAACCACTACACGCAGAAGAGCCTCTCCCTGTCT<br>CCGGGT |
| MHGB712-<br>Fab-Fc LC | 476 | GATATTGTTATGACACAGTCCCCAGATTCATTGGCAGTAAGCCTCGGTGAACGGGCTAC<br>TATTAACTGTAAGTCTTCCCAGAGTGTATTGTTCTCTTCAAATAACAAAAACTACCTGGC<br>ATGGTATCAGCAAAAGCCTGGTCAACCCCCTAAACTTCTCATATACTGGGCATCCACTC<br>GGGAGAGCGGTGTGCCAGACCGTTTCTCAGGGAGTGTGTCAGGTACAGATTTTACACT<br>CACAATTTCCAGCCTCCAAGCCGAAGACGTTGCAGTATATTATTGCCAACAATATCACTC<br>TACACCTTGGACATTTGGTCAAGGTACTAAAGTCGAAATCAAACGGACAGTGGCCGCT<br>CCTTCCGTGTTCATCTTCCCACCTTCCGACGAGCAGCTGAAGTCCGGCACAGCTTCTGTC<br>GTGTGCCTGCTGAACAACTTCTACCCTCGGGAAGCCAAGGTGCAGTGGAAGGTGGACA<br>ATGCCCTGCAGTCCGGCAACTCCCAAGAGTCTGTGACCGAGCAGGACTCCAAGGACAG<br>CACCTACAGCCTGTCCTCCACACTGACCCTGTCCAAGGCCGACTACGAGAAGCACAAG<br>GTGTACGCCTGCGAAGTGACCCATCAGGGCCTGTCTAGCCCTGTGACCAAGTCTTTCAA<br>CCGGGGCGAGTGT |

Engineering of HLA-G scFv-Fc for HLA-G/CD3 Bispecific Generation

HLA-G VH/VL regions engineered as scFvs in either VH-Linker-VL or VL-linker-VH orientations using the linker of SEQ ID NO: 8 (Table 1) as described in Example 2 were further engineered into a scFv-hinge-CH2-CH3 format comprising the Fc silencing mutation (L234A/L235A/D265S) and the T350V/T366L/K392L/T394W mutations designed to promote selective heterodimerization and expressed as IgG1. The polypeptides of SEQ ID NOs: 477 or 495 were used as the constant domain hinge-CH2-CH3.

(huIgG1_G1m(17)-hinge-Fc_C220S_AAS_ZWB)
SEQ ID NO: 477
EPKSSDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

LNGKEYKCKVSNKALPAPIEKTISKAKGQPREPQVYVLPPSREEMTKNQ

VSLLCLVKGFYPSDIAVEWESNGQPENNYLTWPPVLDSDGSFFLYSKLT

VDKSRWQQGNVFSCSVMHEALHNHYTQKSLSLSPG

SEQ ID NO: 495
EPKSSDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

LNGKEYKCKVSNKALPAPIEKTISKAKGQPREPQVYVLPPSREEMTKNQ

VSLLCLVKGFYPSDIAVEWESNGQPENNYLTWPPVLDSDGSFFLYSKLT

VDKSRWQQGNVFSCSVMHEALHNHYTQKSLSLSPGK

Amino acid sequences of anti-HLA-G molecules in scFv-hinge-CH2-CH3 format (scFv-Fc) are shown in Table 45. cDNA sequences of anti-HLA-G molecules in scFv-hinge-CH2-CH3 format (scFv-Fc) are listed in Table 46.

TABLE 45 amino acid sequences of anti-HLA-G scFv-Fc bi-specific arms.

| scFv-Fc | SEQ ID NO: | Amino acid sequence |
|---|---|---|
| MHGB732-LH-scFv-Fc, no C-terminal Lys | 478 | DIVMTQSPDSLAVSLGERATINCKSSQSVLHSSNNKNYLTWFQQKPGQPPKLLIYWASTRE SGVPDRFSGSGSGTDFTLTISSLQAEDVAVYYCHQYYSTPPTFGQGTKVEIKGGSEGKSSGS GSESKSTGGSQVQLQQSGPGLVKPSQTLSLTCAISGDSVSSNSAAWNWIRQSPSRGLEWL GRTYYRSKWYNDYAVSVKSRITINPDTSKNQISLQLNSVTPEDTAVYYCAGDRRYGIVGLPF AYWGQGTLVTVSSEPKSSDKTHTCPPCPAPEAAGGPSVFLFPPKPKDTLMISRTPEVTCVV VSVSHEDPEVKFNWYVDGVEVHNAKTKPREEQYNSTYRVVSVLTVLHQDWLNGKEYKCK VSNKALPAPIEKTISKAKGQPREPQVYVLPPSREEMTKNQVSLLCLVKGFYPSDIAVEWESN GQPENNYLTWPPVLDSDGSFFLYSKLTVDKSRWQQGNVFSCSVMHEALHNHYTQKSLSLS PG |
| MHGB732-LH-scFv-Fc | 490 | DIVMTQSPDSLAVSLGERATINCKSSQSVLHSSNNKNYLTWFQQKPGQPPKLLIYWASTRE SGVPDRFSGSGSGTDFTLTISSLQAEDVAVYYCHQYYSTPPTFGQGTKVEIKGGSEGKSSGS GSESKSTGGSQVQLQQSGPGLVKPSQTLSLTCAISGDSVSSNSAAWNWIRQSPSRGLEWL GRTYYRSKWYNDYAVSVKSRITINPDTSKNQISLQLNSVTPEDTAVYYCAGDRRYGIVGLPF AYWGQGTLVTVSSEPKSSDKTHTCPPCPAPEAAGGPSVFLFPPKPKDTLMISRTPEVTCVV VSVSHEDPEVKFNWYVDGVEVHNAKTKPREEQYNSTYRVVSVLTVLHQDWLNGKEYKCK VSNKALPAPIEKTISKAKGQPREPQVYVLPPSREEMTKNQVSLLCLVKGFYPSDIAVEWESN GQPENNYLTWPPVLDSDGSFFLYSKLTVDKSRWQQGNVFSCSVMHEALHNHYTQKSLSLS PGK |
| MHGB737-LH-scFv-Fc | 479 | DIQMTQSPSTLSASVGDRVTITCRASQSISSWLAWYQQKPGKAPKLLIYKASSLESGVPSRF SGSGSGTEFTLTISSLQPDDFATYYCQQYNSYSLTFGGGTKVDIKGGSEGKSSGSGSESKSTG GSEVQLLESGGGLVQPGGSLRLSCAASGFTFSSYAMHWVRQAPGKGLEWVSGISGSGFST YYVVDSVKGRFTISRDNSKNTLYLQMNSLRAEDTAVYYCAKDNLVAGTVFDYWGQGTLVTV SSEPKSSDKTHTCPPCPAPEAAGGPSVFLFPPKPKDTLMISRTPEVTCVVVSVSHEDPEVKF NWYVDGVEVHNAKTKPREEQYNSTYRVVSVLTVLHQDWLNGKEYKCKVSNKALPAPIEKT ISKAKGQPREPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPG |

TABLE 46 cDNA sequences of anti-HLA-G scFv-Fc bi-specific arms.

| scFv-Fc | SEQ ID NO: | cDNA sequence |
|---|---|---|
| MHGB732-scFv-LH-Fc | 480 | GACATCGTGATGACCCAGTCTCCAGACAGCCTGGCTGTGTCTCTGGGCGAGAGAGCTA CCATCAACTGCAAGTCCAGCCAGTCCGTGCTGCACTCCTCCAACAACAAGAACTACCTG ACCTGGTTCCAGCAGAAGCCCGGCCAGCCTCCTAAGCTGCTGATCTACTGGGCCTCCAC CCGCGAGTCTGGTGTGCCCGATAGATTCTCCGGCTCTGGCTCTGGCACCGACTTTACCC TGACAATCAGCTCCCTGCAGGCCGAGGATGTGGCCGTGTACTACTGCCACCAGTACTAC AGCACCCCTCCTACCTTTGGCCAGGGCACCAAGGTGGAAATCAAGGGCGGATCTGAGG GAAAGTCCAGCGGCTCCGGCAGCGAAAGCAAGTCCACCGGCGGAAGCCAGGTTCAGC TGCAGCAGTCTGGCCCTGGACTGGTCAAGCCCTCTCAGACCCTGTCTCTGACCTGTGCC ATCTCCGGCGACTCCGTGTCCTCTAATTCTGCCGCCTGGAACTGGATCCGGCAGTCTCC TAGTAGAGGCCTGGAATGGCTGGGCAGAACCTACTACCGGTCCAAGTGGTACAACGAC TACGCCGTGTCCGTGAAGTCCCGGATCACCATCAATCCCGACACCTCCAAGAACCAGAT |

TABLE 46-continued cDNA sequences of anti-HLA-G scFv-Fc bi-specific arms.

| scFv-Fc | SEQ ID NO: | cDNA sequence |
|---|---|---|
| | | CTCCCTGCAGCTCAACAGCGTGACCCCTGAGGATACCGCCGTGTACTACTGTGCCGGCG<br>ATCGGAGATATGGCATCGTGGGCCTGCCTTTTGCTTACTGGGGACAGGGCACACTGGT<br>CACCGTTTCTTCTGAGCCCAAATCTAGCGACAAAACTCACACTTGTCCACCGTGCCCAGC<br>ACCTGAAGCAGCAGGGGGACCGTCAGTCTTCCTCTTCCCCCCAAAACCCAAGGACACCC<br>TCATGATCTCCCGGACCCCTGAGGTCACATGCGTGGTGGTGAGCGTGAGCCACGAAGA<br>CCCTGAGGTCAAGTTCAACTGGTACGTGGACGGCGTGGAGGTGCATAATGCCAAGACA<br>AAGCCGCGGGAGGAGCAGTACAACAGCACGTACCGTGTGGTCAGCGTCCTCACCGTCC<br>TGCACCAGGACTGGCTGAATGGCAAGGAGTACAAGTGCAAGGTGTCCAACAAAGCCC<br>TCCCAGCCCCCATCGAGAAAACCATCTCCAAAGCCAAAGGGCAGCCCCGAGAACCACA<br>GGTGTACGTGCTGCCCCCATCCCGGGAGGAGATGACCAAGAACCAGGTCAGCCTGCTG<br>TGCCTGGTCAAAGGCTTCTATCCCAGCGACATCGCCGTGGAGTGGGAGAGCAATGGGC<br>AGCCGGAGAACAACTACCTCACCTGGCCTCCCGTGCTGGACTCCGACGGCTCCTTCTTC<br>CTCTACAGCAAGCTCACCGTGGACAAGTCCAGATGGCAGCAGGGGAACGTCTTCTCAT<br>GCTCCGTGATGCATGAGGCTCTGCACAACCACTACACGCAGAAGTCTCTCCCTGTCT<br>CCGGGA |
| MHGB737-<br>LH-scFv-<br>Fc | 481 | gatattcagatgacccaatcccccagtacccttagtgctagtgtgggagaccgagtgaccattacctgcagagcat<br>cccaatccataagctcctggctcgcctggtatcagcaaaagccaggcaaggcacctaagctgcttatttacaaagc<br>atcctcattggagtccggcgtaccctcacgtttctctggctcaggctccgggacagagtttacattgaccatctctag<br>ccttcagccagatgactttgctacatactattgtcaacaatataacagctactctctgacctctcggggggtgggacca<br>aagtggatattaaaggcggctccgagggcaagagcagcggcagcggcagcgagagcaagagcaccggcggca<br>gcgaagtccaacttcttgagagtggtggtggcctcgtccagccaggaggttctctccggctctcatgtgctgcaagt<br>ggctttacttttcagctcttacgccatgcactgggtgcgacaggctcccgggaagggtcttgagtgggtgtctggtata<br>agtggttcaggcttttcaacctactatgtcgattccgtcaagggccggtttacaatttcaagggacaattctaagaat<br>acactgtatctccaaatgaatagtctcagagccgaagataccgccgtttactactgcgccaaagataatcttgtggc<br>tgggactgtcttcgactattgggtcagggtacattggtaaccgtaagtagtgagcccaaatctagcgacaaaact<br>cacacatgtccaccgtgcccagcacctgaagcagcaggggaccgtcagtcttcctcttcccccccaaaacccaagg<br>acaccctcatgatctcccggacccctgaggtcacatgcgtggtggtgagcgtgagccacgaagaccctgaggtca<br>agttcaactggtacgtggacggcgtggaggtgcataatgccaagacaaagccgcgggaggagcagtacaacagc<br>acgtaccgtgtggtcagcgtcctcaccgtcctgcaccaggactggctgaatggcaaggagtacaagtgcaaggtct<br>ccaacaaagccctcccagcccccatcgagaaaaccatctccaaagccaaagggcagccccgagaaccacaggtg<br>tacgtgctgcccccatcccgggaggagatgaccaagaaccaggtcagcctgctgtgcctggtcaaaggcttctatc<br>ccagcgacatcgccgtggagtgggagagcaatgggcagccggagaacaactacctcacctggcctcccgtgctgg<br>actccgacggctccttcttcctctacagcaagctcaccgtggacaagtctagatggcagcaggggaacgtcttctca<br>tgctccgtgatgcatgaggctctgcacaaccactacacgcagaagagcctctccctgtctccgggt |
| MHGB732-<br>scFv-LH-<br>Fc | 498 | GACATCGTGATGACCCAGTCTCCAGACAGCCTGGCTGTGTCTCTGGGCGAGAGAGCTA<br>CCATCAACTGCAAGTCCAGCCAGTCCGTGCTGCACTCCTCCAACAACAAGAACTACCTG<br>ACCTGGTTCCAGCAGAAGCCCGGCCAGCCTCCTAAGCTGCTGATCTACTGGGCCTCCAC<br>CCGCGAGTCTGGTGTGCCCGATAGATTCTCCGGCTCTGGCTCTGGCACCGACTTTACCC<br>TGACAATCAGCTCCCTGCAGGCCGAGGATGTGGCCGTGTACTACTGCCACCAGTACTAC<br>AGCACCCCTCCTACCTTTGGCCAGGGCACCAAGGTGGAAATCAAGGGCGGATCTGAGG<br>GAAAGTCCAGCGGCTCCGGCAGCGAAAGCAAGTCCACCGGCGGAAGCCAGGTTCAGC<br>TGCAGCAGTCTGGCCCTGGACTGGTCAAGCCCTCTCAGACCCTGTCTCTGACCTGTGCC<br>ATCTCCGGCGACTCCGTGTCCTCTAATTCTGCCGCCTGGAACTGGATCCGGCAGTCTCC<br>TAGTAGAGGCCTGGAATGGCTGGGCAGAACCTACTACCGGTCCAAGTGGTACAACGAC<br>TACGCCGTGTCCGTGAAGTCCCGGATCACCATCAATCCCGACACCTCCAAGAACCAGAT<br>CTCCCTGCAGCTCAACAGCGTGACCCCTGAGGATACCGCCGTGTACTACTGTGCCGGCG<br>ATCGGAGATATGGCATCGTGGGCCTGCCTTTTGCTTACTGGGGACAGGGCACACTGGT<br>CACCGTTTCTTCTGAGCCCAAATCTAGCGACAAAACTCACACTTGTCCACCGTGCCCAGC<br>ACCTGAAGCAGCAGGGGGACCGTCAGTCTTCCTCTTCCCCCCAAAACCCAAGGACACCC<br>TCATGATCTCCCGGACCCCTGAGGTCACATGCGTGGTGGTGAGCGTGAGCCACGAAGA<br>CCCTGAGGTCAAGTTCAACTGGTACGTGGACGGCGTGGAGGTGCATAATGCCAAGACA<br>AAGCCGCGGGAGGAGCAGTACAACAGCACGTACCGTGTGGTCAGCGTCCTCACCGTCC<br>TGCACCAGGACTGGCTGAATGGCAAGGAGTACAAGTGCAAGGTGTCCAACAAAGCCC<br>TCCCAGCCCCCATCGAGAAAACCATCTCCAAAGCCAAAGGGCAGCCCCGAGAACCACA<br>GGTGTACGTGCTGCCCCCATCCCGGGAGGAGATGACCAAGAACCAGGTCAGCCTGCTG<br>TGCCTGGTCAAAGGCTTCTATCCCAGCGACATCGCCGTGGAGTGGGAGAGCAATGGGC<br>AGCCGGAGAACAACTACCTCACCTGGCCTCCCGTGCTGGACTCCGACGGCTCCTTCTTC<br>CTCTACAGCAAGCTCACCGTGGACAAGTCCAGATGGCAGCAGGGGAACGTCTTCTCAT<br>GCTCCGTGATGCATGAGGCTCTGCACAACCACTACACGCAGAAGTCTCTCCCTGTCT<br>CCGGGAAAA |

HLA-G×CD3 Bispecifics

The VH/VL regions of the anti-CD3 antibodies CD3B376, CD3B450, CD3B219, and CD3W246, engineered as Fab-Fcs and the VH/VL regions of the anti-HLA-G antibodies MHGB738, MHGB732 and MHGB737 engineered as scFv-Fcs in both HL and LH orientations as described above, were expressed to generate bispecific antibodies, yielding HLA-G/CD3 bispecific antibodies with a HLA-G binding arm in a format scFv-hinge-CH2-CH3 and a CD3 binding arm in a format of: heavy chain: VH-CH1-linker-CH2-CH3 and light chain: VL-CL (Table 47). B23B62-Fab-Fc arm was used as an isotype control for the CD3-specific arm.

Alternatively, the VH/VL regions of the anti-CD3 antibodies CD3W246, CD3B450, and CD3B219 engineered as scFv-Fcs in HL and/or LH orientations (see Table 47) and the VH/VL regions of the anti-HLA-G antibodies MHGB738, MHGB732 and MHGB737 engineered as Fabs as described above, were expressed to generate bispecific antibodies, yielding HLA-G/CD3 bispecific antibodies with a HLA-G binding arm in the format of a heavy chain VH-CH1-linker-CH2-CH3 and light chain VL-CL and a CD3 binding arm in a format scFv-hinge-CH2-CH3. The linker used to generate the anti-scFv is the linker of SEQ ID NO: 8 (Table 47).

T350V_L351Y_F405A_Y407V CH3 mutations were engineered into one heavy chain and T350V_T366L_K392L_T394W CH3 mutations were engineered into the other heavy chain as described above. In addition, both HK2 and CD3 binding arms were engineered to contain Fc effector silencing mutations L234A_L235A_D265S as described above.

The engineered chains were expressed, and the resulting bispecific constructs purified using standard methods. The bispecifics were characterized for their binding to HLA-G and CD3, their in vitro cytotoxicity, immune checkpoint response, and in vivo efficacy as described in Examples 11-13.

Example 11. BsAb Formatting and In Vitro Testing

T cell redirection against tumor cells has shown significant promise in the clinic, and we asked whether a bispecific antibody (BsAb) which targets HLA-G and the CD3 subunit of the T cell receptor complex would show cytotoxicity against HLA-G expressing tumor cells. Lead v-regions were formatted as BsAbs with a series of CD3-binding redirection arms (Table 48). Briefly, target cells (NCI-H2009-b2m) at 50,000 cells per well were incubated with antibody at concentrations starting from 10 nM and serially by half-log per well. Purified primary T cells were added at a ratio of 3:1 and the mixture was incubated for 72 hr at 37° C. Staining solution was prepared adding LIVE/DEAD Near-IR stain (Dead Cell Stain, L34976, Invitrogen) at 1 uL per 10^6 cells and Brilliant violet anti CD25 (Biolegend cat. #302630) at 5 uL per 10^6 cells in BD FACS staining buffer. Cell mixtures were dissociated with Accutase prior to addition analysis by flow cytometry. Cells were gated on FSC-A vs SSC-A and CFSE (BL-1) vs SSC-A and non-viable tumor cells were identified by total tumor target cell population for CFSE (BL-1) vs Near IR Live/Dead (RL2-H) gating. Data was analyzed using ForeCyt (Sartorius) advanced metrics to calculate tumor cytoxity. All BsAbs displayed the ability to enhance T cell-mediated cytotoxicity when the HLA-G binding v-region was paired with a CD3 binding arm with EC50 values that were correlated to the binding affinities of both the HLA-G targeting arm and the CD3 targeting arm (Table 48).

TABLE 47

HLA-G × CD3 bispecifics.

| Bispecific Name | CD3 arm | CD3 arm SEQ ID NO: | HLA-G arm | HLA-G arm SEQ ID NO: |
|---|---|---|---|---|
| HC3B239 | null-scFv-Fc | 413 | MHGB738-Fab-Fc | HC: 466 LC: 469 |
| HC3B238 | CD3W246-HL-scFv-Fc | 405 | MHGB738-Fab-Fc | HC: 466 LC: 469 |
| HC3B237 | CD3W246-LH-scFv-Fc | 406 | MHGB738-Fab-Fc | HC: 466 LC: 469 |
| HC3B236 | CD3B450-LH-scFv-Fc | 411 | MHGB738-Fab-Fc | HC: 466 LC: 469 |
| HC3B235 | CD3B219-LH-scFv-Fc | 412 | MHGB738-Fab-Fc | HC: 466 LC: 469 |
| HC3B234 | null-scFv-Fc | 413 | MHGB732-Fab-Fc | HC: 465 LC: 468 |
| HC3B233 | CD3W246-HL-scFv-Fc | 405 | MHGB732-Fab-Fc | HC: 465 LC: 468 |
| HC3B232 | CD3W246-LH-scFv-Fc | 406 | MHGB732-Fab-Fc | HC: 465 LC: 468 |
| HC3B231 | CD3B450-LH-scFv-Fc | 411 | MHGB732-Fab-Fc | HC: 465 LC: 468 |
| HC3B230 | CD3B219-LH-scFv-Fc | 412 | MHGB732-Fab-Fc | HC: 465 LC: 468 |
| HC3B128 | B23B62-Fab-Fc | HC: 482 LC: 483 | MHGB732-LH-scFv | 478 |
| HC3B125 | CD3B376-Fab-Fc | HC: 489 LC: 447 | MHGB732-LH-scFv-Fc | 478 |
| HC3B258 | CD3B376-Fab-Fc | HC: 439 LC: 447 | MHGB732-LH-scFv-Fc | 490 |
| HC3B124 | CD3B219-Fab-Fc | HC: 441 LC: 449 | MHGB732-scFv-Fc | 478 |
| HC3B123 | CD3W246-Fab-Fc | HC: 438 LC: 444 | MHGB732-LH-scFv-Fc | 478 |
| HC3B225 | B23B62-Fab | HC: 482 LC: 483 | MHGB737-scFv-Fc | 479 |
| HC3B216 | CD3B376-Fab-Fc | HC: 439 LC: 447 | MHGB737-scFv-Fc | 479 |
| HC3B214 | CD3W246-Fab-Fc | HC: 438 LC: 444 | MHGB737-scFv-Fc | 479 |

TABLE 48

BsAb designs and cytotoxicity

| BsAb Name | CD3 arm | HLA-G arm | Cytotoxicity, EC50 (M) |
|---|---|---|---|
| HC3B239 | null-scFv-Fc | MHGB738-Fab-Fc | NA |
| HC3B238 | CD3W246-HL-scFv-Fc | MHGB738-Fab-Fc | 1.72542E−11 |
| HC3B237 | CD3W246-LH-scFv-Fc | MHGB738-Fab-Fc | 1.32773E−10 |
| HC3B236 | CD3B450-LH-scFv-Fc | MHGB738-Fab-Fc | 4.53748E−09 |
| HC3B235 | CD3B219-LH-scFv-Fc | MHGB738-Fab-Fc | 8.37E−11 |
| HC3B234 | null-scFv-Fc | MHGB732-Fab-Fc | N/A |
| HC3B233 | CD3W246-HL-scFv-Fc | MHGB732-Fab-Fc | N/A |
| HC3B232 | CD3W246-LH-scFv-Fc | MHGB732-Fab-Fc | 6.77438E−12 |
| HC3B231 | CD3B450-LH-scFv-Fc | MHGB732-Fab-Fc | 1.26465E−10 |
| HC3B230 | CD3B219-LH-scFv-Fc | MHGB732-Fab-Fc | 9.91577E−12 |
| HC3B128 | B23B62-Fab | MHGB732-LH-scFv | No data |
| HC3B125 | CD3B376-Fab-Fc, no C-terminal Lys | MHGB732-LH-scFv-Fc, no C-terminal Lys | 5.65197E−11 |
| HC3B258 | CD3B376-Fab-Fc | MHGB732-LH-scFv-Fc | Binding same as HC3B125 |
| HC3B124 | CD3B219-Fab-Fc | MHGB732-scFv-Fc | 3.849E−12 |
| HC3B123 | CD3W246-Fab-Fc | MHGB732-LH-scFv-Fc | 3.24183E−12 |
| HC3B225 | B23B62-Fab | MHGB737-scFv-Fc | No data |
| HC3B216 | CD3B376-Fab-Fc | MHGB737-scFv-Fc | 1.8984E−09 |
| HC3B214 | CD3W246-Fab-Fc | MHGB737-scFv-Fc | 1.37611E−10 |

The BsAbs were further tested for their abilities to mediate T-cell activation and T cell-based cytotoxicity against additional cell lines: Hup-T3 and RERF-LC-Ad-1 (FIGS. 15A-15D). FIGS. 15A-15D show cytotoxicity mediated by HC3B125 against HLA-G expressing tumor cells.

Figure 16:
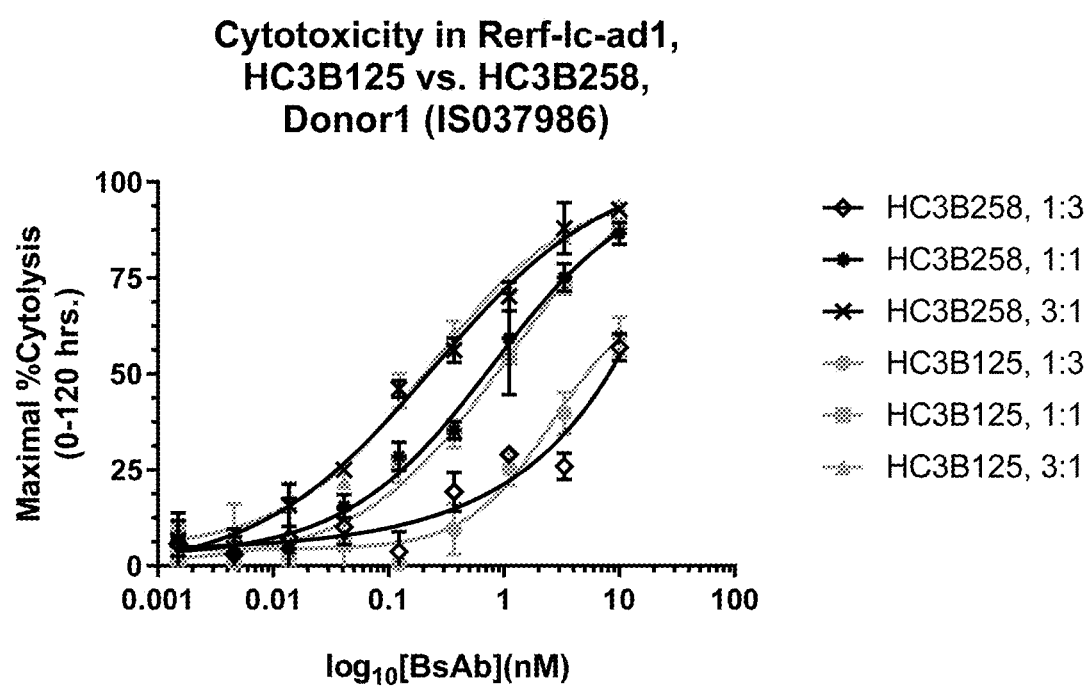
FIG. 16 shows cytotoxicity of HC3B258 and HC3B125 against RERF-LC-Ad-1 cells; Effector (T cell): Target (RERF-LC-Ad1) ratios were 1:3, 1:1, or 3:1, as indicated.

Two BsAbs, HC3B125 and HC3B258, differed only in the presence (HC3B258) or absence (HC3B125) of a codon to express the C-terminal lysine, K447 in the heavy chain. Since the C-terminal lysine of the heavy chain of antibodies is normally proteolytically processed, the two Abs displayed identical mass spectra (Table 49). Additionally, they displayed identical biophysical properties, such as thermal stability and binding affinity for both T cells and for K562-HLA-G cells. Additionally, HC3B258 displayed similar cytotoxicity properties as HC3B125 (FIG. 16).

TABLE 49

Comparison of the biophysical properties of HC3B125 and HC3B258.

| Molecule | Exp. Mass (Da) | Kd (pM) | Tonset | Tm1 | Tm2 | Tagg | Tcell binding (EC50, M) | K562-HLA-G cell binding (EC50, M) |
|---|---|---|---|---|---|---|---|---|
| HC3B258 | 128,772.4 | 13 ± 1.2 | 55.0° C. | 63.0° C. | 81.1° C. | 63.9° C. | 6.0E−08 | 1.1E−08 |
| HC3B125 | 128,772.5 | 11 ± 0.5 | 55.3° C. | 63.6° C. | 81.3° C. | 65.3° C. | 6.0E−08 | 1.2E−08 |

Example 12. Observation of Immune Checkpoint Response

We observed that anti-HLA-G mAbs whose mechanism of cytotoxicity features effector function (e.g. ADCC) and CD3×HLA-G BsAbs could induce killing of all cell types which expressing HLA-G. Tumors often escape immune surveillance via up-regulation of certain immune checkpoint modulators which can inhibit immune cells, such as PD-L1 or CTLA-4[9]. We thus asked whether targeting cancer cells for T cell mediated cytotoxicity via CD3×HLA-G BsAbs could overcome expression of immune checkpoint modulators on tumor cells. We measured whether HLA-G-expressing tumor cells expressed immune checkpoint ligands (Table 50). Briefly, cells were cultured as in Example 11, and were then stained with commercial antibodies targeting the receptors indicated in Table 50. Fluorescence was measured using flow cytometry to determine relative expression levels of each receptor. Interestingly, we observed that RERF-LC-Ad1 cells expressed PD-L1 at levels significantly higher than other target cells and that CD3×HLA-G BsAbs could still mediate T cell based cytotoxicity against RERF-LC-Ad1 cells (FIGS. 15A-15D). We observed that our Abs, which target the α3 domain of HLA-G on tumor cells for T cell based cytotoxicity could overcome immune checkpoint ligand expression on tumor cells.

TABLE 50

Comprehensive analysis of immune checkpoint antigen expression on HLA-G expressing tumor cells

| Ligand name/ Cell line name | Signal fold over negative control | | | | |
|---|---|---|---|---|---|
| | RERF-LCAd1 | JEG-3 | HUP-T3 | BICR6 | HCC1806 |
| PD-L1(CD274, B7-H1) | 43 | 7 | 9 | | |
| PD-L2(CD273, B7-DC) | 2 | 1 | 2 | | |
| Nectin-1 (CD111, PVRL1) | 2 | 1 | 1 | | |
| Poliovirus receptor (CD155) | 18 | 1 | 23 | | |
| HVEM (CD270, TNFRSF14) | 3 | 1 | 1 | | |
| B7H3(CD276) | 21 | 9 | 1 | | |
| Galectin-9 | 1 | 2 | 3 | | |
| B7-1 (CD80, CD28L) | 1 | 1 | 1 | | |
| MICA/B | 6 | | 2 | | 11 |
| ULBP1 | 1 | | 1 | | 1 |
| ULBP2/5/6 | 2 | | 2 | | 10 |
| ULBP3 | 3 | | 2 | | 6 |
| ULBP4 | 2 | | 1 | | 1 |
| NKG2D-FC | 1 | | 1 | | 1 |
| NKp46-Fc | 1 | | 1 | | 1 |
| NKp44-Fc | 1 | | 1 | | 1 |
| NKp30-Fc | 1 | | 1 | | 1 |
| CD46 | 1 | 5 | 9 | 12 | |
| CD55 | 141 | 73 | 21 | 15 | |
| CD59 | 78 | 15 | 291 | 120 | |
| In vitro T cell-based cytotoxicity | yes | no | yes | yes | |
| in vitro ADCC background | ok | ok | ok | ok | ok |
| in vitro CDC | no | partial | not tested | not tested | not tested |

Example 13. In Vivo Efficacy

While the correlation between HLA-G expression in patients and a poor prognosis has been established in most types of cancer, the direct role of HLA-G in tumor escape in vivo has thus far not been demonstrated. There are no murine homologues of HLA-G, but also ILT-2, therefore studying of the role of HLA-G requires xenograft models and humanized mice.

Figure 17A:
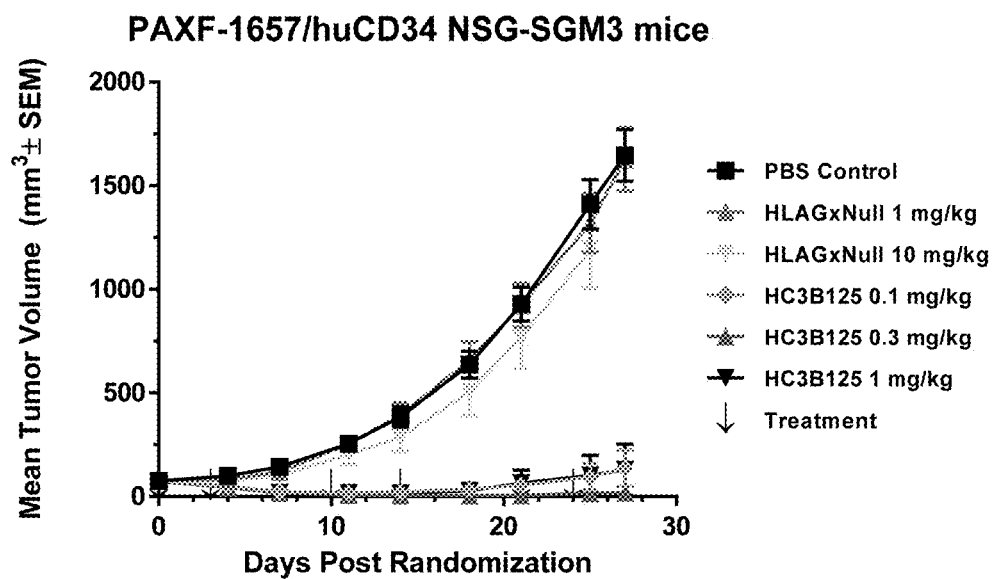
FIGS. 17A-17B show group mean tumor volumes (17A) and individual tumor volumes at day 27 of established pancreatic PDX in CD34$^+$ cell humanized NSG-SGM3 mice treated with either control (HLA-G×Null) or HCB125.
Figure 17B:
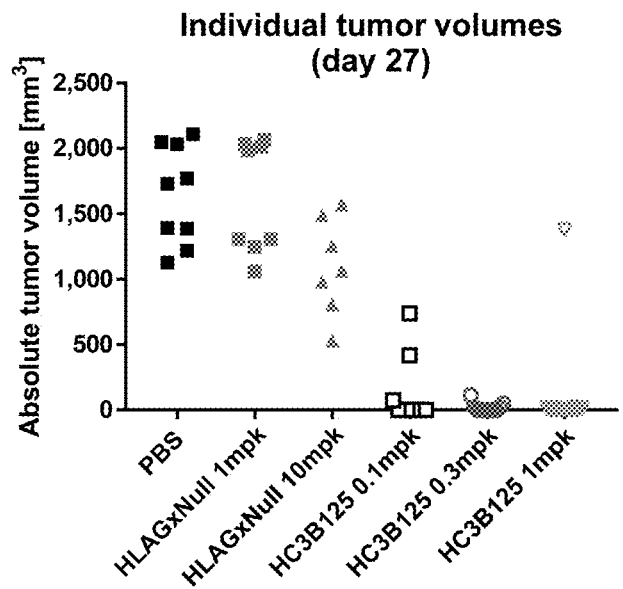

Abs and BsAbs were tested for their abilities to mediate anti-tumor efficacy in vivo in a series of mouse studies. The study shown in (FIG. 17A-17B, Table 51) consisted of efficacy experiment with the pancreatic tumor model PAXF 1657 (Charles River Discovery Research Services Germany GmbH) implanted subcutaneously in humanized female hNSG-SGM3 mice (NOD.Cg-Prkdc$^{scid}$ Tg(CMV-IL3, CSF2, KITLG) from the Jackson Laboratory. Mice engrafted with human umbilical cord blood-derived CD34+ hematopoietic stem cells (HSCs) from three different donors (#2595, #2597 and #5867) had been checked by the animal distributor for the sufficient degree of engraftment of HSCs (>25% human CD45$^+$ cells) 10 to 11 weeks after engraftment. PAXF 1657 tumors were implanted 18 days after arrival and the degree of engraftment was re-checked 2 days prior to randomization. The experiment comprised eight groups of 10 or 11 mice each bearing one PAXF 1657 tumor. The absolute tumor volumes (ATVs) were determined by two-dimensional measurement with a digital caliper (S_Cal EVO Bluetooth, Switzerland) on the day of randomization and then twice weekly. Tumor volumes were calculated according to the formula: Tumor volume=(1× w$^2$)×0.5, where l=largest diameter and w=width (perpendicular diameter) of the tumor (in mm). At tumor volumes of 46.7 mm$^3$ to 117.7 mm$^3$, mice were distributed among the eight groups, aiming at comparable group mean and median tumor volumes while simultaneously ensuring an even distribution, as much as possible, among the groups of mice humanized with HSCs from the three donors. Each antibody was evaluated at two or three dose levels and was administered on days 0, 3, 7, 10, 14, 17, 21, 24 (intravenously, 2×/week). Antitumor efficacy of all groups was assessed using the vehicle control group as a reference. Tumor growth inhibition (TGI) was determined at the end of the treatment period by the comparison of changes in tumor volumes of the test groups relative to changes in the control group and is expressed as the delta TGI value (denoted TGI in text) in percent. The TGI was calculated using the absolute tumor volumes according to the following formula: Delta TGI$_x$ [%]=(1−Mean (T$_x$−T$_o$)/Mean (C$_x$−C$_o$))×100, where T$_o$ and C$_o$ are the absolute tumor volumes in the test and the control group at the start of treatment (i.e. day of randomization) and T$_x$ and G are the corresponding absolute tumor volumes at the end of the treatment period. This was day 25 in this study. The experiment was terminated on day 27. HC3B125 significantly inhibited growth of the tumor model PAXF 1657 in hNSG-SGM3 mice. Tumor growth inhibition compared to the vehicle control group was statistically significant for all three dose levels evaluated (Kruskal-Wallis test combined with Dunn's post test, Table 50). Tumors regressed completely in 6/11 animals in the 0.002 mg, 8/11 animals in the 0.006 mg and 9/11 in the 0.02 mg HC3B125 groups. At the end of the experiment, there were 6/7/6 tumor-free survivors in the 0.002 mg/0.006 mg/0.02 mg HC3B125 groups respectively.

Tumor growth was not inhibited by HC3B128 at either dose level tested. While a small reduction in group mean tumor volume was observed at the higher doses of HC3B128 compared to the control group, the differences were not statistically significant (Table 50).

TABLE 51

Pancreatic PDX model efficacy statistics

| Group ID | Treatment[1] | Dose Level [mg/day] | Schedule [Day] | Route | Delta TGI [%] (Day)[2] | Regressions[3] PR | CR | TFS | Td [Days] | Tq [Days] |
|---|---|---|---|---|---|---|---|---|---|---|
| | | | Tumor Model PAXF 1657-Exp. S317h | | | | | | | |
| 1 | Control Vehicle | 0.1 ml/dose | 0, 3, 7, 10, 14, 17, 21, 24 | i.v. | n/a | 0 | 0 | 0 | 7.2 | 12.6 |
| 2 | HC3B128.004 | 0.02 | 0, 3, 7, 10, 14, 17, 21, 24 | i.v. | 8.4 (25) | 0 | 0 | 0 | 8.9 | 13.5 |
| 3 | HC3B128.004 | 0.2 | 0, 3, 7, 10, 14, 17, 21, 24 | i.v. | 16.2 (25) | 0 | 0 | 0 | 9.7 | 15.3 |
| 4 | HC3B125 | 0.002 | 0, 3, 7, 10, 14, 17, 21, 24 | i.v. | 98.5 (25) | 2 | 6 | 6 | n.r. | n.r. |
| 5 | HC3B125 | 0.006 | 0, 3, 7, 10, 14, 17, 21, 24 | i.v. | 104.4 (25) | 3 | 8 | 7 | n.r. | n.r. |
| 6 | HC3B125 | 0.02 | 0, 3, 7, 10, 14, 17, 21, 24 | i.v. | 97.9 (25) | 1 | 9 | 6 | n.r. | n.r. | n/a = not applicable;
n.r. = not reached (i.e. group median RTVs always < 200%/400%)
Vehicle for antibodies: PBS
[2]Delta TGI values in each group were calculated on the first measurement day after the final 2QW treatment was administered (day 25) according to the formula given in the section Error! Reference source not found.; for additional TGI, T/C and tumor regression values, see Appendix 1.
[3]Partial (PR) and complete regressions (CR) were determined according to the section Error! Reference source not found.
TFS: tumor-free survivor; Td, tumor doubling time; tq, tumor quadrupling time.

Figure 18:
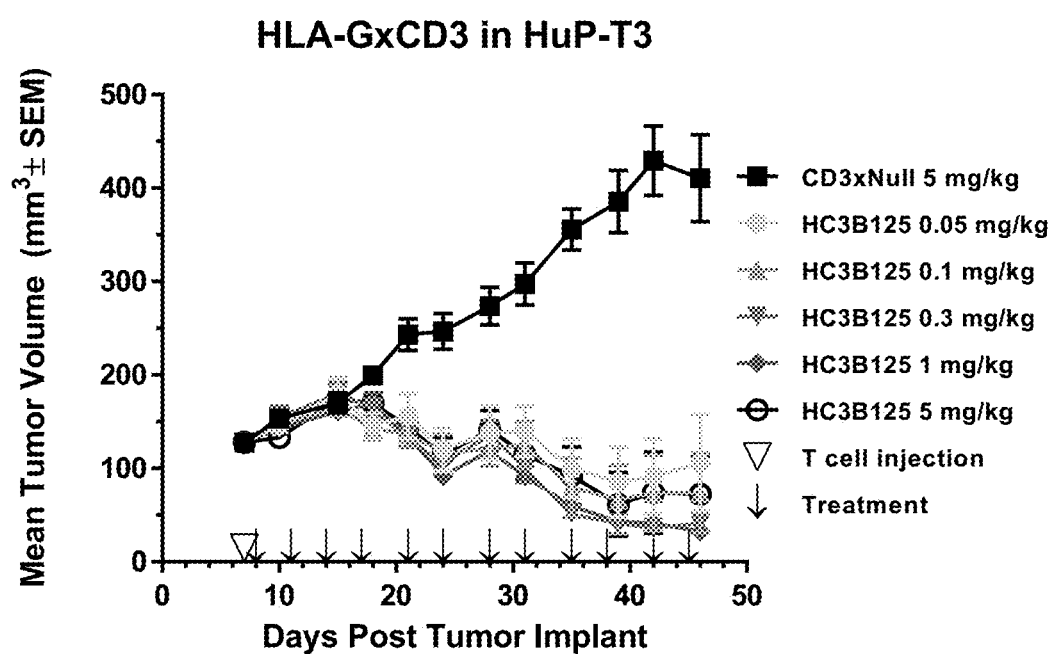
FIG. 18 shows group mean tumor volumes of established Hup-T3 xenografts in T cell humanized NSG mice treated with either control (CD3×Null) or HCB125.

Treatment with HC3B125 could also result in tumor growth inhibition in a HuP-T3 cell line derived xenograft (CDX) model (FIG. 18, Table 52). The study consisted of efficacy experiment with the pancreatic tumor model HuP-T3 (Sigma-Aldrich) implanted subcutaneously (10e6 cells/mouse in 50% Cultrex (R&D Systems)) in T cell humanized NSG (Jackson Laboratories) mice. The experiment comprised six groups of 10 mice each bearing one HuP-T3 tumor. On day 7, at tumor volumes of 75 mm$^3$ to 150 mm$^3$, mice were randomized into six groups, aiming to have comparable group mean and median tumor volumes. Mice were engrafted intraperitoneally with T cells (20e6 cells/mouse, 0.2 mL/animal; ALLCELLS 6093 T Cell Donor) after randomization on the same day as randomization. HC3B125 antibody was evaluated at five dose levels. Antitumor efficacy of all groups was assessed using the NullxCD3 treated group as a reference. Treatment started 1 day post T cell engraftment and was performed on days 8, 11, 14, 17, 21, 24, 28, 31, 35, 38, 42, 48 (intraperitoneally, 2x/week). Tumor growth inhibition was determined at the end of the treatment period by the comparison of changes in group mean tumor volumes of the test groups relative to changes in that of the NullxCD3 treated control group and was expressed as the delta TGI value (denoted TGI in text) in percent. Day 42 post tumor implantation was used as the last day for TGI calculations. The experiment was terminated on day 46. HC3B125 significantly inhibited growth of the tumor model HuPT3 in hNSG mice. Tumor growth inhibition compared to the NullxCD3 treated control group was statistically significant for all five dose levels evaluated (Table 52).

TABLE 52

HuP-T3 model efficacy statistics

| Group | Construct | Dose/animal | % ΔTGI (Day 42) | No of CRs (Day 42) |
|---|---|---|---|---|
| 1 | CD3xNull | — | | |
| 2 | HC3B125 | 0.05 mg/kg | 112% ***p < 0.0001 | |
| 3 | HC3B125 | 0.1 mg/kg | 118% ***p < 0.0001 | 1/9 CRs |

TABLE 52-continued

HuP-T3 model efficacy statistics

| Group | Construct | Dose/animal | % ΔTGI (Day 42) | No of CRs (Day 42) |
|---|---|---|---|---|
| 4 | HC3B125 | 0.3 mg/kg | 130% ***p < 0.0001 | 1/10 CRs |
| 5 | HC3B125 | 1 mg/kg | 129% ***p < 0.0001 | |
| 6 | HC3B125 | 5 mg/kg | 118% ***p < 0.0001 | 3/10 CRs |

Example 14. Efficacy of HC3B258 in Established Patient-Derived Xenograft Tumor Models in T-Cell Humanized NSG Mice To explore the correlation between HLA-G expression and in vivo antitumor efficacy the HC3B258 antibody was evaluated in a panel of ten human patient-derived xenograft (PDX) solid tumor models (Charles River Discovery Research Services Germany GmbH) in female NOD.Cg-Prkdc$^{scid}$ Il2rg$^{tm1Wjl}$/SzJ (NSG) mice humanized intraperitoneally (ip) with human pan-T cells (Table 53). PDX models selected for panel inclusion represented tumor models across various solid tumor indications and demonstrated varying levels (including no expression) of HLA-G target expression as determined by Western blot (WB) evaluation.

PDX models were derived from patient surgical specimens. Tumors harvested from xenografts in serial passage were excised and cut into 3-4 mm length fragments, then implanted subcutaneously (SC) in the flank of NSG mice. Tumor bearing mice were randomized when tumors reached 100-200 mm$^3$ into 3 groups of 5 animals based on tumor volume, such that all groups had similar mean values. On the day of randomization, animals were humanized with in vitro activated and expanded human pan T cells (ALLCELLS, donor 6093) at a concentration of 1×10$^8$ cells/mL, for an ip injection of 2×10$^7$ cells in 0.2 mL per mouse. On the day after T-cell humanization, mice were dosed intravenously (iv) twice a week with HC3B258 at either 0.03 or 0.3 mg/kg, or vehicle, for a total of 6 doses (days 1, 5, 8, 12, 15 and 19 post T-cell humanization). T-cell-humanized mice were given Fc block (Clone 2.4G2; BioXCell,) at 0.2 mg/mouse ip and intravenous immunoglobulin (IVIG) (Gammagard, NDC #00944-2700-05) at 10 mg/mouse ip at least 30 minutes prior to HC3B258 dosing to correct for the low Ig environment in the NSG mouse.

Tumor volume was calculated using the formula:

$$\text{tumor volume (mm}^3) = (D \times d^2 / 2)$$

where 'D' represents the larger diameter, and the smaller diameter of the tumor as determined by caliper measurements. Antitumor efficacy, including biological and statistical significance, was compared between HC3B258-treated groups and the vehicle-treated control group at the end of the treatment when at least 4 mice remained in each group (ranged 34-42 days). Antitumor efficacy was expressed a percent tumor growth inhibition (% ΔTGI) and defined as the difference between mean tumor burden of the treatment and control groups, calculated as $$\%\Delta\text{TGI} = ([(TVc-TVc0)-(TVt-TVt0)]/(TVc-TVc0)) \times 100$$

where '$TV_c$': is the mean tumor burden of a given control group, '$TV_{c0}$' is the mean initial tumor burden of a given control group, is the mean tumor burden of the treatment group, and '$TV_{t0}$' is the mean initial tumor burden of the treatment group. A complete response (CR) was defined as no palpable tumor on the final day of analysis. Statistical significance of tumor volume measurements was calculated using the ΔTGI analysis (InVivoLDA Shiny App Version 4.0, Johnson&Johsnon). Differences between groups were considered significant when p≤0.05.

buffered saline/0.1% Tween 20 (TBST), the membrane was incubated with the appropriate secondary antibody (diluted 1:1,000 in Odyssey blocking buffer containing 0.1% Tween 20) for 1 hour at RT. After 3 to 5 washing steps with TBST, the membrane was scanned on the Odyssey IR imaging system (LI-COR Biosciences) at 700 nm. The data was analyzed as follows. The 2 IR fluorescent detection channels of the Odyssey System enable simultaneous 2-color target analysis, for HLA-G and vinculin, used as a loading control. The fluorescence intensity (FI) of each sample in both channels was determined (Image Studio) and normalized by dividing the FI value of HLA-G by the FI of vinculin.

Robust antitumor efficacy and complete responses (CRs) were observed following HC3B258 treatment at 0.03 and 0.3 mg/kg in several PDX models with WB>1 (PRXF MRI-H1579, LXFA 2204, and RXF 488) and WB 0.1-1.0 (RXF 2706 and PAXF 2175) levels of HLA-G protein expression. Treatment with HC3B258 in the other PDX models (RXF 616, BXF 439, and MEXF 1792) expressing comparable levels of HLA-G resulted in dose-dependent antitumor efficacy, with an intermediate response to treatment at 0.03 mg/kg, demonstrating a possible inherent resistance mechanism in these models (Table 53). Treatment with HC3B258 at either dose level did not result in biologically significant antitumor efficacy in the PDX models with negative HLA-G protein expression. Taken together, these results indicate potent specific antitumor efficacy at varying levels of HLA-G target expression, while no effect is present in the absence of HLA-G expression.

TABLE 53

Effect of HC3B258 Treatment on Established Patient-Derived Xenograft Tumor Models in T-Cell Humanized NSG Mice.

| PDX Model | Tumor Type | % ΔTGI 0.03 mg/kg | % ΔTGI 0.3 mg/kg | CRs 0.03 mg/kg | CRs 0.3 mg/kg | WB |
|---|---|---|---|---|---|---|
| PRXF MRI-H1579 | Prostate | 110% | 112% | 5/5 | 5/5 | 2.5 |
| LXFA 2204 | Lung | 118% | 118% | 5/5 | 5/5 | 4.8 |
| RXF 488 | Renal | 166% | 164% | 5/5 | 5/5 | 1.33 |
| RXF 2706 | Renal | 123% | 123% | 4/4 | 3/3 | 0.62 |
| PAXF 2175 | Pancreatic | 132% | 132% | 5/5 | 5/5 | 0.26 |
| RXF 616 | Renal | 60% | 101% | 0/5 | 1/5 | 0.36 |
| BXF 439 | Bladder | 58% | 113% | 0/5 | 0/5 | 0.53 |
| MEXF 1792 | Melanoma | 39% | 99% | 0/5 | 0/5 | 1.1 |
| GXF 281 | Gastric | −14% | −2% | 0/5 | 0/5 | 0.02 |
| PAXF 546 | Pancreatic | 8% | −12% | 0/5 | 0/5 | 0.07 | p < 0.05 versus control except where noted as not significant (ns);
CR — complete response.

Western blot (WB) analysis was performed on PDX total protein lysates using anti-HLA-G antibody 4H84 (Abcam). PDX total protein lysates (each at 5 mg/mL) were received from Charles River, Germany. Each sample (10 μL) was loaded on a NuPAGE® 4-12% Bis-Tris Mini gel. The MagicMark™ XP Western Protein Standard and the Full Range Rainbow Molecular Weight Marker were used as protein markers. The NuPAGE® MOPS SDS Running Buffer was used. The gel ran 15 minutes at 70 V, followed by 50 minutes at 200 V. After electrophoresis, the gel was transferred to a polyvinylidene fluoride (PVDF) membrane using the XCell II Blot Module (ThermoFisher Scientific), following the manufacturer's protocol. After 2 hours of blotting at 30 V, the membrane was transferred in Odyssey blocking buffer for 1 hour at RT. The membrane was incubated overnight at 4° C. with the primary antibody 4H84 (1:200) and anti-vinculin diluted (1:5,000) in Odyssey blocking buffer. After 3 to 4 washing steps with Tris-

REFERENCES

1 Lee, N. et al. The membrane-bound and soluble forms of HLA-G bind identical sets of endogenous peptides but differ with respect to TAP association. *Immunity* 3, 591-600, doi:10.1016/1074-7613(95)90130-2 (1995).
2 Juch, H. et al. A novel sandwich ELISA for alpha1 domain based detection of soluble HLA-G heavy chains. *J Immunol Methods* 307, 96-106, doi:10.1016/j.jim.2005.09.016 (2005).
3 Morales, P. J., Pace, J. L., Platt, J. S., Langat, D. K. & Hunt, J. S. Synthesis of beta(2)-microglobulin-free, disulphide-linked HLA-G5 homodimers in human placental villous cytotrophoblast cells. *Immunology* 122, 179-188, doi:10.1111/j.1365-2567.2007.02623.x (2007).
4 Carosella, E. D., Favier, B., Rouas-Freiss, N., Moreau, P. & Lemaoult, J. Beyond the increasing complexity of the immunomodulatory HLA-G molecule. *Blood* 111, 4862-4870, doi:10.1182/blood-2007-12-127662 (2008).

5 Carosella, E. D., Rouas-Freiss, N., Tronik-Le Roux, D., Moreau, P. & LeMaoult, J. HLA-G: An Immune Checkpoint Molecule. *Adv Immunol* 127, 33-144, doi:10.1016/bs.ai.2015.04.001 (2015).

6 Clements, C. S. et al. Crystal structure of HLA-G: a nonclassical MHC class I molecule expressed at the fetal-maternal interface. *Proc Natl Acad Sci USA* 102, 3360-3365, doi:10.1073/pnas.0409676102 (2005).

7 Shields, R. L. et al. Lack of fucose on human IgG1 N-linked oligosaccharide improves binding to human Fcgamma RIII and antibody-dependent cellular toxicity. *J Biol Chem* 277, 26733-26740, doi:10.1074/jbc.M202069200 (2002).

8 Zhang, D. et al. Functional optimization of agonistic antibodies to OX40 receptor with novel Fc mutations to promote antibody multimerization. *MAbs* 9, 1129-1142, doi:10.1080/19420862.2017.1358838 (2017).

9 Wilky, B. A. Immune checkpoint inhibitors: The linchpins of modern immunotherapy. *Immunol Rev* 290, 6-23, doi: 10.1111/imr.12766 (2019).

SEQUENCE LISTING (499 sequences)

SEQ ID NO: 1 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 2 - protein, 246 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 3 - protein, 154 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSSD

SEQ ID NO: 4 - protein, 246 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRAKQSSLPTIPIMGIVAGLVVLAAVVTGAAVAAVLWRKKSSD

SEQ ID NO: 5 - protein, 319 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDL

SEQ ID NO: 6 - protein, 227 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDL

SEQ ID NO: 7 - protein, 116 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASE

SEQ ID NO: 8 - protein, 20 aa, Artificial Sequence
  source: /note="Description of Artificial Sequence: Synthetic peptide"
GGSEGKSSGSGSESKSTGGS

SEQ ID NO: 9 - protein, 8 aa, Artificial Sequence
  source: /note="Description of Artificial Sequence: Synthetic peptide"
GGGSGGGS

SEQ ID NO: 10 - protein, 12 aa, Artificial Sequence
  source: /note="Description of Artificial Sequence: Synthetic peptide"
GGGSGGGSGGGS

SEQ ID NO: 11 - protein, 16 aa, Artificial Sequence
  source: /note="Description of Artificial Sequence: Synthetic peptide"
GGGSGGGSGGGSGGGS

SEQ ID NO: 12 - protein, 20 aa, Artificial Sequence
  source: /note="Description of Artificial Sequence: Synthetic peptide"
GGGSGGGSGGGSGGGSGGGS

SEQ ID NO: 13 - protein, 15 aa, Artificial Sequence
  source: /note="Description of Artificial Sequence: Synthetic peptide"
GGGGSGGGGSGGGGS

SEQ ID NO: 14 - protein, 20 aa, Artificial Sequence
  source: /note="Description of Artificial Sequence: Synthetic peptide"
GGGGSGGGGSGGGGSGGGGS

SEQ ID NO: 15 - protein, 25 aa, Artificial Sequence
  source: /note="Description of Artificial Sequence: Synthetic peptide"
GGGGSGGGGSGGGGSGGGGSGGGGS

SEQ ID NO: 16 - protein, 18 aa, Artificial Sequence
  source: /note="Description of Artificial Sequence: Synthetic peptide"
GSTSGSGKPGSGEGSTKG

SEQ ID NO: 17 - protein, 14 aa, Artificial Sequence
  source: /note="Description of Artificial Sequence: Synthetic peptide"
IRPRAIGGSKPRVA

SEQ ID NO: 18 - protein, 15 aa, Artificial Sequence
  source: /note="Description of Artificial Sequence: Synthetic peptide"
GKGGSGKGGSGKGGS

SEQ ID NO: 19 - protein, 15 aa, Artificial Sequence
  source: /note="Description of Artificial Sequence: Synthetic peptide"
GGKGSGGKGSGGKGS

SEQ ID NO: 20 - protein, 15 aa, Artificial Sequence
  source: /note="Description of Artificial Sequence: Synthetic peptide"
GGGKSGGGKSGGGKS

SEQ ID NO: 21 - protein, 15 aa, Artificial Sequence
  source: /note="Description of Artificial Sequence: Synthetic peptide"
GKGKSGKGKSGKGKS

SEQ ID NO: 22 - protein, 15 aa, Artificial Sequence
  source: /note="Description of Artificial Sequence: Synthetic peptide"
GGGKSGGKGSGKGGS

SEQ ID NO: 23 - protein, 15 aa, Artificial Sequence
  source: /note="Description of Artificial Sequence: Synthetic peptide"
GKPGSGKPGSGKPGS

SEQ ID NO: 24 - protein, 20 aa, Artificial Sequence
  source: /note="Description of Artificial Sequence: Synthetic peptide"
GKPGSGKPGSGKPGSGKPGS

SEQ ID NO: 25 - protein, 20 aa, Artificial Sequence
  source: /note="Description of Artificial Sequence: Synthetic peptide"
GKGKSGKGKSGKGKSGKGKS

SEQ ID NO: 26 - protein, 14 aa, Artificial Sequence
  source: /note="Description of Artificial Sequence: Synthetic peptide"
STAGDTHLGGEDFD

SEQ ID NO: 27 - protein, 15 aa, Artificial Sequence
  source: /note="Description of Artificial Sequence: Synthetic peptide"
GEGGSGEGGSGEGGS

SEQ ID NO: 28 - protein, 15 aa, Artificial Sequence
  source: /note="Description of Artificial Sequence: Synthetic peptide"
GGEGSGGEGSGGEGS

SEQ ID NO: 29 - protein, 15 aa, Artificial Sequence
  source: /note="Description of Artificial Sequence: Synthetic peptide"
GEGESGEGESGEGES

SEQ ID NO: 30 - protein, 15 aa, Artificial Sequence
  source: /note="Description of Artificial Sequence: Synthetic peptide"
GGGESGGEGSGEGGS

SEQ ID NO: 31 - protein, 20 aa, Artificial Sequence
  source: /note="Description of Artificial Sequence: Synthetic peptide"
GEGESGEGESGEGESGEGES

SEQ ID NO: 32 - protein, 18 aa, Artificial Sequence
  source: /note="Description of Artificial Sequence: Synthetic peptide"
GSTSGSGKPGSGEGSTKG

SEQ ID NO: 33 - protein, 19 aa, Artificial Sequence
  source: /note="Description of Artificial Sequence: Synthetic peptide"
PRGASKSGSASQTGSAPGS

SEQ ID NO: 34 - protein, 19 aa, Artificial Sequence
  source: /note="Description of Artificial Sequence: Synthetic peptide"
GTAAAGAGAAGGAAAGAAG

SEQ ID NO: 35 - protein, 19 aa, Artificial Sequence
  source: /note="Description of Artificial Sequence: Synthetic peptide"
GTSGSSGSGSGGSGSGGGG

SEQ ID NO: 36 - protein, 20 aa, Artificial Sequence
  source: /note="Description of Artificial Sequence: Synthetic peptide"
GKPGSGKPGSGKPGSGKPGS

SEQ ID NO: 37 - protein, 4 aa, Artificial Sequence
  source: /note="Description of Artificial Sequence: Synthetic peptide"
GSGS

SEQ ID NO: 38 - protein, 10 aa, Artificial Sequence
  source: /note="Description of Artificial Sequence: Synthetic peptide"
APAPAPAPAP

SEQ ID NO: 39 - protein, 20 aa, Artificial Sequence
  source: /note="Description of Artificial Sequence: Synthetic peptide"
APAPAPAPAPAPAPAPAPAP

SEQ ID NO: 40 - protein, 32 aa, Artificial Sequence
  source: /note="Description of Artificial Sequence: Synthetic polypeptide"
AEAAAKEAAAKEAAAAKEAAAAKEAAAAKAAA

SEQ ID NO: 41 - protein, 419 aa, Artificial Sequence
  source: /note="Description of Artificial Sequence: Synthetic polypeptide"
MIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIGGGGSGLNDIFEAQKIEWHE

SEQ ID NO: 42 - protein, 456 aa, Artificial Sequence
  source: /note="Description of Artificial Sequence: Synthetic polypeptide"
RIIPRHLQLGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDLGGGGSHHHHHHGSGLNDIFEAQKIEWHE

SEQ ID NO: 43 - protein, 314 aa, Artificial Sequence
  source: /note="Description of Artificial Sequence: Synthetic polypeptide"
GSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 44 - DNA, 1359 bp, Artificial Sequence
  source: /note="Description of Artificial Sequence: Synthetic polynucleotide"
atggcttgggtgtggacattgttgtttctgatggctgctgctcaatctattcaagctaggatcattcctagacatctgcaactcggaggcggaggcagcggaggaggaggatctggaggaggaggatctattcagaggacacctaagattcaagtgtactctagacatcctgctgagaacggcaagagcaactttctgaactgctatgtgagcggctttcatcctagcgatattgaagtggatctgctgaaaaacggcgaacgtattgaaaaagtggaacatagcgatctgagctttagcaaagattggagcttttatctgctgtattataccgaatttacccctaccgaaaaagatgaatatgcctgcagagtgaaccatgtgaccctgagccagcctaagattgtgaaatgggatagagatatgggaggaggaggctctggaggaggaggatctggaggcggaggcagcggctctcatagcatgagatattttagcgctgcagtgagccgtcctggacgtggagaacctaggtttattgctatgggctatgtggatgatacccagtttgtgaggtttgatagcgatagcgcctctcctaggatggaacctagagctccctgggtggaacaggaaggcccagaatattgggaagaagaaaccaggaacaccaaagcacatgctcagaccgatcgtatgaacctgcagaccctgagaggctattataaccagagcgaagcatctagccataccctgcagtggatgattggctgcgatctgggcagcgatggcagactgctgagaggctatgaacagtatgcatatgatggcaaagattatctggcactgaacgaagatctgaggagctggaccgctgctgataccgctgctcagattagcaagaggaagtgcgaagctgctaacgtggctgaacagagacgcgcatatctggaaggcacctgcgtggaatggctgcataggtatctggaaaacggcaaagaaatgctgcagagagctgatcctcctaaaacccatgtgacccatcatcctgtgtttgattatgaagctaccctgaggtgctgggctctgggcttctatcctgctgagattattctgacctggcagagagatggagaagatcagactcaagatgtcgagttggtcgagactagacctgctggagatggcacctttcagaagtgggcagctgttgtcgtgcctagcggagaagaacagagatatacctgccatgtgcagcatgaaggcctgcctgaacctctgatgctgaggtggaaacagagcagcttgcctactattcctattggaggaggaggatctcaccatcatcatcatcactga

SEQ ID NO: 45 - protein, 435 aa, Artificial Sequence
  source: /note="Description of Artificial Sequence: Synthetic polypeptide"
QARIIPRHLQLGGGGSGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIGGGGSHHHHHH

SEQ ID NO: 46 - DNA, 1359 bp, Artificial Sequence; identical to SEQ ID NO: 44
  source: /note="Description of Artificial Sequence: Synthetic polynucleotide"

SEQ ID NO: 47 - protein, 433 aa, Artificial Sequence
  source: /note="Description of Artificial Sequence: Synthetic polypeptide"
RIIPRHLQLGGGGSGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIGGGGSHHHHHH

SEQ ID NO: 48 - protein, 312 aa, Artificial Sequence
  source: /note="Description of Artificial Sequence: Synthetic polypeptide"
GSHSMRYFYTAVSRPGRGQPRFIAVGYVDDTQFVRFDSDAESPRMEPRAPWVEQEGPEYWDRETQNMKTATQTYQANLRTLLRYYNQSEAGSHTFQKMYGCDLGPDGRLLRGYEQFAYDGRDYIILNEDLRSWTAADMAAQNTQRKWEAAGAAEQHRTYLEGECLEWLRRYLENGKETLQRADPPKTNVTHHPVSDYEATLRCWALGFYPAEITLTWQRDGEEQTEDTELVETRPTGDGTFQKWAAVVVPSGEEQRYTCHVQHEGLPKPLTLRWEPSSQSTILIGGGGSHHHHHHGSGLNDIFEAQKIEWHE

SEQ ID NO: 49 - protein, 99 aa, Artificial Sequence
  source: /note="Description of Artificial Sequence: Synthetic polypeptide"
IQRTPKIQVYSRHPPENGKPNFLNCYVSGFHPSDIEVDLLKNGEKMGKVEHSDLSFSKDWSFYLLYYTEFTPNEKDEYACRVNHVTLSGPRTVKWDRDM

SEQ ID NO: 50 - protein, 125 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSS

SEQ ID NO: 51 - protein, 113 aa, Artificial Sequence
  source: /note="Description of Artificial Sequence: Synthetic polypeptide"
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIK

SEQ ID NO: 52 - protein, 122 aa, Artificial Sequence
  source: /note="Description of Artificial Sequence: Synthetic polypeptide"
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSS

SEQ ID NO: 53 - protein, 114 aa, Artificial Sequence
  source: /note="Description of Artificial Sequence: Synthetic polypeptide"
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIK

SEQ ID NO: 54 - protein, 125 aa, Artificial Sequence
  source: /note="Description of Artificial Sequence: Synthetic polypeptide"
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSS

SEQ ID NO: 55 - protein, 113 aa, Artificial Sequence
  source: /note="Description of Artificial Sequence: Synthetic polypeptide"
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIK

SEQ ID NO: 56 - protein, 121 aa, Artificial Sequence
  source: /note="Description of Artificial Sequence: Synthetic polypeptide"
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSS

SEQ ID NO: 57 - protein, 113 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIK

SEQ ID NO: 58 - protein, 117 aa, Artificial Sequence
  source: /note="Description of Artificial Sequence: Synthetic polypeptide"
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSS

SEQ ID NO: 59 - protein, 115 aa, Artificial Sequence
  source: /note="Description of Artificial Sequence: Synthetic polypeptide"
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIK

SEQ ID NO: 60 - protein, 121 aa, Artificial Sequence
  source: /note="Description of Artificial Sequence: Synthetic polypeptide"
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSS

SEQ ID NO: 61 - protein, 113 aa, Artificial Sequence
  source: /note="Description of Artificial Sequence: Synthetic polypeptide"
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIK

SEQ ID NO: 62 - protein, 121 aa, Artificial Sequence
  source: /note="Description of Artificial Sequence: Synthetic polypeptide"
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSS

SEQ ID NO: 63 - protein, 113 aa, Artificial Sequence
  source: /note="Description of Artificial Sequence: Synthetic polypeptide"
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIK

SEQ ID NO: 64 - protein, 120 aa, Artificial Sequence
  source: /note="Description of Artificial Sequence: Synthetic polypeptide"
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSS

SEQ ID NO: 65 - protein, 107 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIK

SEQ ID NO: 66 - protein, 120 aa, Artificial Sequence
  source: /note="Description of Artificial Sequence: Synthetic polypeptide"
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSS

SEQ ID NO: 67 - protein, 107 aa, Artificial Sequence; identical to SEQ ID NO: 65
  source: /note="Description of Artificial Sequence: Synthetic polypeptide"

SEQ ID NO: 68 - protein, 121 aa, Artificial Sequence
  source: /note="Description of Artificial Sequence: Synthetic polypeptide"
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSS

SEQ ID NO: 69 - protein, 113 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIK

SEQ ID NO: 70 - protein, 7 aa, Artificial Sequence
  source: /note="Description of Artificial Sequence: Synthetic peptide"
SNSAAWN

SEQ ID NO: 71 - protein, 18 aa, Artificial Sequence
  source: /note="Description of Artificial Sequence: Synthetic peptide"
RTYYRSKWYNDYAVSVKS

SEQ ID NO: 72 - protein, 13 aa, Artificial Sequence
  source: /note="Description of Artificial Sequence: Synthetic peptide"
DRRYGIVGLPFAY

SEQ ID NO: 73 - protein, 7 aa, Artificial Sequence
  source: /note="Description of Artificial Sequence: Synthetic peptide"
NNSAAWN

SEQ ID NO: 74 - protein, 10 aa, Artificial Sequence
  source: /note="Description of Artificial Sequence: Synthetic peptide"
YGSGTLLFDY

SEQ ID NO: 75 - protein, 7 aa, Artificial Sequence
  source: /note="Description of Artificial Sequence: Synthetic peptide"
SNSASWN

SEQ ID NO: 76 - protein, 18 aa, Artificial Sequence
  source: /note="Description of Artificial Sequence: Synthetic peptide"
RTYYRSEWFNDYAVSVKS

SEQ ID NO: 77 - protein, 13 aa, Artificial Sequence
  source: /note="Description of Artificial Sequence: Synthetic peptide"
EARIGVAGKGFDY

SEQ ID NO: 78 - protein, 7 aa, Artificial Sequence
  source: /note="Description of Artificial Sequence: Synthetic peptide"
SNRAAWN

SEQ ID NO: 79 - protein, 18 aa, Artificial Sequence
  source: /note="Description of Artificial Sequence: Synthetic peptide"
RTYYRSEWYNDYAVSVKS

SEQ ID NO: 80 - protein, 9 aa, Artificial Sequence
  source: /note="Description of Artificial Sequence: Synthetic peptide"
VRAAVPFDY

SEQ ID NO: 81 - protein, 7 aa, Artificial Sequence
  source: /note="Description of Artificial Sequence: Synthetic peptide"
SSSYYWG

SEQ ID NO: 82 - protein, 16 aa, Artificial Sequence
  source: /note="Description of Artificial Sequence: Synthetic peptide"
NIYYSGTTYYNPSLKS

SEQ ID NO: 83 - protein, 7 aa, Artificial Sequence
  source: /note="Description of Artificial Sequence: Synthetic peptide"
GARDFDS

SEQ ID NO: 84 - protein, 9 aa, Artificial Sequence
  source: /note="Description of Artificial Sequence: Synthetic peptide"
VRPGIPFDY

SEQ ID NO: 85 - protein, 5 aa, Artificial Sequence
  source: /note="Description of Artificial Sequence: Synthetic peptide"
SYAMH

SEQ ID NO: 86 - protein, 17 aa, Artificial Sequence
  source: /note="Description of Artificial Sequence: Synthetic peptide"
GISGSGFSTYYVDSVKG

SEQ ID NO: 87 - protein, 11 aa, Artificial Sequence
  source: /note="Description of Artificial Sequence: Synthetic peptide"
DNLVAGTVFDY

SEQ ID NO: 88 - protein, 17 aa, Artificial Sequence
  source: /note="Description of Artificial Sequence: Synthetic peptide"
KSSQSVLHSSNNKNYLT

SEQ ID NO: 89 - protein, 7 aa, Artificial Sequence
  source: /note="Description of Artificial Sequence: Synthetic peptide"
WASTRES

SEQ ID NO: 90 - protein, 9 aa, Artificial Sequence
  source: /note="Description of Artificial Sequence: Synthetic peptide"
HQYYSTPPT

SEQ ID NO: 91 - protein, 17 aa, Artificial Sequence
  source: /note="Description of Artificial Sequence: Synthetic peptide"
KSSQSVLYSSKNKNYLA

SEQ ID NO: 92 - protein, 10 aa, Artificial Sequence
  source: /note="Description of Artificial Sequence: Synthetic peptide"
QQYYSTFPYT

SEQ ID NO: 93 - protein, 17 aa, Artificial Sequence
  source: /note="Description of Artificial Sequence: Synthetic peptide"
KSSQSVLFRSNNKNYLA

SEQ ID NO: 94 - protein, 9 aa, Artificial Sequence
  source: /note="Description of Artificial Sequence: Synthetic peptide"
QQYYSTPRT

SEQ ID NO: 95 - protein, 17 aa, Artificial Sequence
  source: /note="Description of Artificial Sequence: Synthetic peptide"
KSSQSVLFSSNNKNYLA

SEQ ID NO: 96 - protein, 9 aa, Artificial Sequence
  source: /note="Description of Artificial Sequence: Synthetic peptide"
QQYHSTPWT

SEQ ID NO: 97 - protein, 17 aa, Artificial Sequence
  source: /note="Description of Artificial Sequence: Synthetic peptide"
KSSQSVLYSSSNKSYLA

SEQ ID NO: 98 - protein, 11 aa, Artificial Sequence
  source: /note="Description of Artificial Sequence: Synthetic peptide"
QQYYSTPRMYT

SEQ ID NO: 99 - protein, 17 aa, Artificial Sequence
  source: /note="Description of Artificial Sequence: Synthetic peptide"
KSSQSVLFSSNKKNYLA

SEQ ID NO: 100 - protein, 9 aa, Artificial Sequence
  source: /note="Description of Artificial Sequence: Synthetic peptide"
QQYNSTPWT

SEQ ID NO: 101 - protein, 17 aa, Artificial Sequence
  source: /note="Description of Artificial Sequence: Synthetic peptide"
ESSQSVLFSSNKKNYLA

SEQ ID NO: 102 - protein, 11 aa, Artificial Sequence
  source: /note="Description of Artificial Sequence: Synthetic peptide"
RASQSISSWLA

SEQ ID NO: 103 - protein, 7 aa, Artificial Sequence
  source: /note="Description of Artificial Sequence: Synthetic peptide"
KASSLES

SEQ ID NO: 104 - protein, 9 aa, Artificial Sequence
  source: /note="Description of Artificial Sequence: Synthetic peptide"
QQYNSYSLT

SEQ ID NO: 105 - protein, 9 aa, Artificial Sequence
  source: /note="Description of Artificial Sequence: Synthetic peptide"
GDSVSSNSA

SEQ ID NO: 106 - protein, 7 aa, Artificial Sequence
  source: /note="Description of Artificial Sequence: Synthetic peptide"
YYRSKWY

SEQ ID NO: 107 - protein, 12 aa, Artificial Sequence
  source: /note="Description of Artificial Sequence: Synthetic peptide"
DRRYGIVGLPFA

SEQ ID NO: 108 - protein, 9 aa, Artificial Sequence
  source: /note="Description of Artificial Sequence: Synthetic peptide"
GDSVSNNSA

SEQ ID NO: 109 - protein, 9 aa, Artificial Sequence
  source: /note="Description of Artificial Sequence: Synthetic peptide"
YGSGTLLFD

SEQ ID NO: 110 - protein, 7 aa, Artificial Sequence
  source: /note="Description of Artificial Sequence: Synthetic peptide"
YYRSEWF

SEQ ID NO: 111 - protein, 12 aa, Artificial Sequence
  source: /note="Description of Artificial Sequence: Synthetic peptide"
EARIGVAGKGFD

SEQ ID NO: 112 - protein, 9 aa, Artificial Sequence
  source: /note="Description of Artificial Sequence: Synthetic peptide"
GDSVSSNRA

SEQ ID NO: 113 - protein, 7 aa, Artificial Sequence
  source: /note="Description of Artificial Sequence: Synthetic peptide"
YYRSEWY

SEQ ID NO: 114 - protein, 8 aa, Artificial Sequence
  source: /note="Description of Artificial Sequence: Synthetic peptide"
VRAAVPFD

SEQ ID NO: 115 - protein, 9 aa, Artificial Sequence
  source: /note="Description of Artificial Sequence: Synthetic peptide"
GGSITSSSY

SEQ ID NO: 116 - protein, 5 aa, Artificial Sequence
  source: /note="Description of Artificial Sequence: Synthetic peptide"
YYSGT

SEQ ID NO: 117 - protein, 6 aa, Artificial Sequence
  source: /note="Description of Artificial Sequence: Synthetic peptide"
GARDFD

SEQ ID NO: 118 - protein, 8 aa, Artificial Sequence
  source: /note="Description of Artificial Sequence: Synthetic peptide"
VRPGIPFD

SEQ ID NO: 119 - protein, 7 aa, Artificial Sequence
  source: /note="Description of Artificial Sequence: Synthetic peptide"
GFTFSSY

SEQ ID NO: 120 - protein, 6 aa, Artificial Sequence
  source: /note="Description of Artificial Sequence: Synthetic peptide"
SGSGFS

SEQ ID NO: 121 - protein, 10 aa, Artificial Sequence
  source: /note="Description of Artificial Sequence: Synthetic peptide"
DNLVAGTVFD

SEQ ID NO: 122 - protein, 13 aa, Artificial Sequence
  source: /note="Description of Artificial Sequence: Synthetic peptide"
SQSVLHSSNNKNY

SEQ ID NO: 123 - protein, 3 aa, Artificial Sequence
  source: /note="Description of Artificial Sequence: Synthetic peptide"
WAS

SEQ ID NO: 124 - protein, 6 aa, Artificial Sequence
  source: /note="Description of Artificial Sequence: Synthetic peptide"
YYSTPP

SEQ ID NO: 125 - protein, 13 aa, Artificial Sequence
  source: /note="Description of Artificial Sequence: Synthetic peptide"
SQSVLYSSKNKNY

SEQ ID NO: 126 - protein, 7 aa, Artificial Sequence
  source: /note="Description of Artificial Sequence: Synthetic peptide"
YYSTFPY

SEQ ID NO: 127 - protein, 13 aa, Artificial Sequence
  source: /note="Description of Artificial Sequence: Synthetic peptide"
SQSVLFRSNNKNY

SEQ ID NO: 128 - protein, 6 aa, Artificial Sequence
  source: /note="Description of Artificial Sequence: Synthetic peptide"
YYSTPR

SEQ ID NO: 129 - protein, 13 aa, Artificial Sequence
  source: /note="Description of Artificial Sequence: Synthetic peptide"
SQSVLFSSNNKNY

SEQ ID NO: 130 - protein, 6 aa, Artificial Sequence
  source: /note="Description of Artificial Sequence: Synthetic peptide"
YHSTPW

SEQ ID NO: 131 - protein, 13 aa, Artificial Sequence
  source: /note="Description of Artificial Sequence: Synthetic peptide"
SQSVLYSSSNKSY

SEQ ID NO: 132 - protein, 13 aa, Artificial Sequence
  source: /note="Description of Artificial Sequence: Synthetic peptide"
SQSVLFSSNKKNY

SEQ ID NO: 133 - protein, 6 aa, Artificial Sequence
  source: /note="Description of Artificial Sequence: Synthetic peptide"
YNSTPW

SEQ ID NO: 134 - protein, 7 aa, Artificial Sequence
  source: /note="Description of Artificial Sequence: Synthetic peptide"
SQSISSW

SEQ ID NO: 135 - protein, 3 aa, Artificial Sequence
  source: /note="Description of Artificial Sequence: Synthetic peptide"
KAS

SEQ ID NO: 136 - protein, 6 aa, Artificial Sequence
  source: /note="Description of Artificial Sequence: Synthetic peptide"
YNSYSL

SEQ ID NO: 137 - protein, 10 aa, Artificial Sequence
  source: /note="Description of Artificial Sequence: Synthetic peptide"
GDSVSSNSAA

SEQ ID NO: 138 - protein, 9 aa, Artificial Sequence
  source: /note="Description of Artificial Sequence: Synthetic peptide"
TYYRSKWYN

SEQ ID NO: 139 - protein, 15 aa, Artificial Sequence
  source: /note="Description of Artificial Sequence: Synthetic peptide"
AGDRRYGIVGLPFAY

SEQ ID NO: 140 - protein, 10 aa, Artificial Sequence
  source: /note="Description of Artificial Sequence: Synthetic peptide"
GDSVSNNSAA

SEQ ID NO: 141 - protein, 12 aa, Artificial Sequence
  source: /note="Description of Artificial Sequence: Synthetic peptide"
ARYGSGTLLFDY

SEQ ID NO: 142 - protein, 10 aa, Artificial Sequence
  source: /note="Description of Artificial Sequence: Synthetic peptide"
GDSVSSNSAS

SEQ ID NO: 143 - protein, 9 aa, Artificial Sequence
  source: /note="Description of Artificial Sequence: Synthetic peptide"
TYYRSEWFN

SEQ ID NO: 144 - protein, 15 aa, Artificial Sequence
  source: /note="Description of Artificial Sequence: Synthetic peptide"
AREARIGVAGKGFDY

SEQ ID NO: 145 - protein, 10 aa, Artificial Sequence
  source: /note="Description of Artificial Sequence: Synthetic peptide"
GDSVSSNRAA

SEQ ID NO: 146 - protein, 9 aa, Artificial Sequence
  source: /note="Description of Artificial Sequence: Synthetic peptide"
TYYRSEWYN

SEQ ID NO: 147 - protein, 11 aa, Artificial Sequence
  source: /note="Description of Artificial Sequence: Synthetic peptide"
ARVRAAVPFDY

SEQ ID NO: 148 - protein, 10 aa, Artificial Sequence
  source: /note="Description of Artificial Sequence: Synthetic peptide"
GGSITSSSYY

SEQ ID NO: 149 - protein, 7 aa, Artificial Sequence
  source: /note="Description of Artificial Sequence: Synthetic peptide"
IYYSGTT

SEQ ID NO: 150 - protein, 9 aa, Artificial Sequence
  source: /note="Description of Artificial Sequence: Synthetic peptide"
AAGARDFDS

SEQ ID NO: 151 - protein, 11 aa, Artificial Sequence
  source: /note="Description of Artificial Sequence: Synthetic peptide"
ARVRPGIPFDY

SEQ ID NO: 152 - protein, 8 aa, Artificial Sequence
  source: /note="Description of Artificial Sequence: Synthetic peptide"
GFTFSSYA

SEQ ID NO: 153 - protein, 8 aa, Artificial Sequence
  source: /note="Description of Artificial Sequence: Synthetic peptide"
ISGSGFST

SEQ ID NO: 154 - protein, 13 aa, Artificial Sequence
  source: /note="Description of Artificial Sequence: Synthetic peptide"
AKDNLVAGTVFDY

SEQ ID NO: 155 - protein, 12 aa, Artificial Sequence
  source: /note="Description of Artificial Sequence: Synthetic peptide"
QSVLHSSNNKNY

SEQ ID NO: 156 - protein, 9 aa, Artificial Sequence
  source: /note="Description of Artificial Sequence: Synthetic peptide"
HQYYSTPPT

SEQ ID NO: 157 - protein, 12 aa, Artificial Sequence
  source: /note="Description of Artificial Sequence: Synthetic peptide"
QSVLYSSKNKNY

SEQ ID NO: 158 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 159 - protein, 12 aa, Artificial Sequence
  source: /note="Description of Artificial Sequence: Synthetic peptide"
QSVLFRSNNKNY

SEQ ID NO: 160 - protein, 9 aa, Artificial Sequence
  source: /note="Description of Artificial Sequence: Synthetic peptide"
QQYYSTPRT

SEQ ID NO: 161 - protein, 12 aa, Artificial Sequence
  source: /note="Description of Artificial Sequence: Synthetic peptide"
QSVLFSSNNKNY

SEQ ID NO: 162 - protein, 9 aa, Artificial Sequence
  source: /note="Description of Artificial Sequence: Synthetic peptide"
QQYHSTPWT

SEQ ID NO: 163 - protein, 12 aa, Artificial Sequence
  source: /note="Description of Artificial Sequence: Synthetic peptide"
QSVLYSSSNKSY

SEQ ID NO: 164 - protein, 11 aa, Artificial Sequence
  source: /note="Description of Artificial Sequence: Synthetic peptide"
QQYYSTPRMYT

SEQ ID NO: 165 - protein, 12 aa, Artificial Sequence
  source: /note="Description of Artificial Sequence: Synthetic peptide"
QSVLFSSNKKNY

SEQ ID NO: 166 - protein, 9 aa, Artificial Sequence
  source: /note="Description of Artificial Sequence: Synthetic peptide"
QQYNSTPWT

SEQ ID NO: 167 - protein, 6 aa, Artificial Sequence
  source: /note="Description of Artificial Sequence: Synthetic peptide"
QSISSW

SEQ ID NO: 168 - protein, 9 aa, Artificial Sequence
  source: /note="Description of Artificial Sequence: Synthetic peptide"
QQYNSYSLT

SEQ ID NO: 169 - protein, 12 aa, Artificial Sequence
  source: /note="Description of Artificial Sequence: Synthetic peptide"
GDSVSSNSAAWN

SEQ ID NO: 170 - protein, 11 aa, Artificial Sequence
  source: /note="Description of Artificial Sequence: Synthetic peptide"
RTYYRSKWYND

SEQ ID NO: 171 - protein, 13 aa, Artificial Sequence
  source: /note="Description of Artificial Sequence: Synthetic peptide"
DRRYGIVGLPFAY

SEQ ID NO: 172 - protein, 12 aa, Artificial Sequence
  source: /note="Description of Artificial Sequence: Synthetic peptide"
GDSVSNNSAAWN

SEQ ID NO: 173 - protein, 10 aa, Artificial Sequence
  source: /note="Description of Artificial Sequence: Synthetic peptide"
YGSGTLLFDY

SEQ ID NO: 174 - protein, 12 aa, Artificial Sequence
  source: /note="Description of Artificial Sequence: Synthetic peptide"
GDSVSSNSASWN

SEQ ID NO: 175 - protein, 11 aa, Artificial Sequence
  source: /note="Description of Artificial Sequence: Synthetic peptide"
RTYYRSEWFND

SEQ ID NO: 176 - protein, 13 aa, Artificial Sequence
  source: /note="Description of Artificial Sequence: Synthetic peptide"
EARIGVAGKGFDY

SEQ ID NO: 177 - protein, 12 aa, Artificial Sequence
  source: /note="Description of Artificial Sequence: Synthetic peptide"
GDSVSSNRAAWN

SEQ ID NO: 178 - protein, 11 aa, Artificial Sequence
  source: /note="Description of Artificial Sequence: Synthetic peptide"
RTYYRSEWYND

SEQ ID NO: 179 - protein, 9 aa, Artificial Sequence
  source: /note="Description of Artificial Sequence: Synthetic peptide"
VRAAVPFDY

SEQ ID NO: 180 - protein, 12 aa, Artificial Sequence
  source: /note="Description of Artificial Sequence: Synthetic peptide"
GGSITSSSYYWG

SEQ ID NO: 181 - protein, 9 aa, Artificial Sequence
  source: /note="Description of Artificial Sequence: Synthetic peptide"
NIYYSGTTY

SEQ ID NO: 182 - protein, 7 aa, Artificial Sequence
  source: /note="Description of Artificial Sequence: Synthetic peptide"
GARDFDS

SEQ ID NO: 183 - protein, 9 aa, Artificial Sequence
  source: /note="Description of Artificial Sequence: Synthetic peptide"
VRPGIPFDY

SEQ ID NO: 184 - protein, 10 aa, Artificial Sequence
  source: /note="Description of Artificial Sequence: Synthetic peptide"
GFTFSSYAMH

SEQ ID NO: 185 - protein, 10 aa, Artificial Sequence
  source: /note="Description of Artificial Sequence: Synthetic peptide"
GISGSGFSTY

SEQ ID NO: 186 - protein, 11 aa, Artificial Sequence
  source: /note="Description of Artificial Sequence: Synthetic peptide"
DNLVAGTVFDY

SEQ ID NO: 187 - protein, 17 aa, Artificial Sequence
  source: /note="Description of Artificial Sequence: Synthetic peptide"
KSSQSVLHSSNNKNYLT

SEQ ID NO: 188 - protein, 7 aa, Artificial Sequence
  source: /note="Description of Artificial Sequence: Synthetic peptide"
WASTRES

SEQ ID NO: 189 - protein, 9 aa, Artificial Sequence
  source: /note="Description of Artificial Sequence: Synthetic peptide"
HQYYSTPPT

SEQ ID NO: 190 - protein, 17 aa, Artificial Sequence
  source: /note="Description of Artificial Sequence: Synthetic peptide"
KSSQSVLYSSKNKNYLA

SEQ ID NO: 191 - protein, 10 aa, Artificial Sequence
  source: /note="Description of Artificial Sequence: Synthetic peptide"
QQYYSTFPYT

SEQ ID NO: 192 - protein, 17 aa, Artificial Sequence
  source: /note="Description of Artificial Sequence: Synthetic peptide"
KSSQSVLFRSNNKNYLA

SEQ ID NO: 193 - protein, 9 aa, Artificial Sequence
  source: /note="Description of Artificial Sequence: Synthetic peptide"
QQYYSTPRT

SEQ ID NO: 194 - protein, 17 aa, Artificial Sequence
  source: /note="Description of Artificial Sequence: Synthetic peptide"
KSSQSVLFSSNNKNYLA

SEQ ID NO: 195 - protein, 9 aa, Artificial Sequence
  source: /note="Description of Artificial Sequence: Synthetic peptide"
QQYHSTPWT

SEQ ID NO: 196 - protein, 17 aa, Artificial Sequence
  source: /note="Description of Artificial Sequence: Synthetic peptide"
KSSQSVLYSSSNKSYLA

SEQ ID NO: 197 - protein, 11 aa, Artificial Sequence
  source: /note="Description of Artificial Sequence: Synthetic peptide"
QQYYSTPRMYT

SEQ ID NO: 198 - protein, 17 aa, Artificial Sequence
  source: /note="Description of Artificial Sequence: Synthetic peptide"
KSSQSVLFSSNKKNYLA

SEQ ID NO: 199 - protein, 9 aa, Artificial Sequence
  source: /note="Description of Artificial Sequence: Synthetic peptide"
QQYNSTPWT

SEQ ID NO: 200 - protein, 17 aa, Artificial Sequence
  source: /note="Description of Artificial Sequence: Synthetic peptide"
ESSQSVLFSSNKKNYLA

SEQ ID NO: 201 - protein, 11 aa, Artificial Sequence
  source: /note="Description of Artificial Sequence: Synthetic peptide"
RASQSISSWLA

SEQ ID NO: 202 - protein, 7 aa, Artificial Sequence
  source: /note="Description of Artificial Sequence: Synthetic peptide"
KASSLES

SEQ ID NO: 203 - protein, 9 aa, Artificial Sequence
  source: /note="Description of Artificial Sequence: Synthetic peptide"
QQYNSYSLT

SEQ ID NO: 204 - protein, 455 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 452 aa, Artificial Sequence
  source: /note="Description of Artificial Sequence: Synthetic polypeptide"
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 455 aa, Artificial Sequence
  source: /note="Description of Artificial Sequence: Synthetic polypeptide"
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 451 aa, Artificial Sequence
  source: /note="Description of Artificial Sequence: Synthetic polypeptide"
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 447 aa, Artificial Sequence
  source: /note="Description of Artificial Sequence: Synthetic polypeptide"
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 451 aa, Artificial Sequence
  source: /note="Description of Artificial Sequence: Synthetic polypeptide"
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 451 aa, Artificial Sequence
  source: /note="Description of Artificial Sequence: Synthetic polypeptide"
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 450 aa, Artificial Sequence
  source: /note="Description of Artificial Sequence: Synthetic polypeptide"
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 454 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 213 - protein, 449 aa, Artificial Sequence
  source: /note="Description of Artificial Sequence: Synthetic polypeptide"
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 450 aa, Artificial Sequence
  source: /note="Description of Artificial Sequence: Synthetic polypeptide"
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 215 - protein, 220 aa, Artificial Sequence
  source: /note="Description of Artificial Sequence: Synthetic polypeptide"
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - protein, 221 aa, Artificial Sequence
  source: /note="Description of Artificial Sequence: Synthetic polypeptide"
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 220 aa, Artificial Sequence
  source: /note="Description of Artificial Sequence: Synthetic polypeptide"
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 218 - protein, 220 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 222 aa, Artificial Sequence
  source: /note="Description of Artificial Sequence: Synthetic polypeptide"
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - protein, 220 aa, Artificial Sequence
  source: /note="Description of Artificial Sequence: Synthetic polypeptide"
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 220 aa, Artificial Sequence
  source: /note="Description of Artificial Sequence: Synthetic polypeptide"
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 214 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 223 - protein, 220 aa, Artificial Sequence; identical to SEQ ID NO: 215
  source: /note="Description of Artificial Sequence: Synthetic polypeptide"

SEQ ID NO: 224 - protein, 214 aa, Artificial Sequence; identical to SEQ ID NO: 222
  source: /note="Description of Artificial Sequence: Synthetic polypeptide"

SEQ ID NO: 225 - protein, 220 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 226 - DNA, 1365 bp, Artificial Sequence
  source: /note="Description of Artificial Sequence: Synthetic polynucleotide"
caggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - DNA, 660 bp, Artificial Sequence
  source: /note="Description of Artificial Sequence: Synthetic polynucleotide"
gacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 228 - DNA, 1356 bp, Artificial Sequence
  source: /note="Description of Artificial Sequence: Synthetic polynucleotide"
caggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 229 - DNA, 663 bp, Artificial Sequence
  source: /note="Description of Artificial Sequence: Synthetic polynucleotide"
gacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 230 - DNA, 1365 bp, Artificial Sequence
  source: /note="Description of Artificial Sequence: Synthetic polynucleotide"
caggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 231 - DNA, 660 bp, Artificial Sequence
  source: /note="Description of Artificial Sequence: Synthetic polynucleotide"
gacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 232 - DNA, 1353 bp, Artificial Sequence
  source: /note="Description of Artificial Sequence: Synthetic polynucleotide"
caggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 233 - DNA, 660 bp, Artificial Sequence
  source: /note="Description of Artificial Sequence: Synthetic polynucleotide"
gacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 234 - DNA, 1341 bp, Artificial Sequence
  source: /note="Description of Artificial Sequence: Synthetic polynucleotide"
cagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 235 - DNA, 666 bp, Artificial Sequence
  source: /note="Description of Artificial Sequence: Synthetic polynucleotide"
gacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 236 - DNA, 1353 bp, Artificial Sequence
  source: /note="Description of Artificial Sequence: Synthetic polynucleotide"
gaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 238 - DNA, 1353 bp, Artificial Sequence
  source: /note="Description of Artificial Sequence: Synthetic polynucleotide"
caggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 239 - DNA, 660 bp, Artificial Sequence
  source: /note="Description of Artificial Sequence: Synthetic polynucleotide"
gacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 240 - DNA, 1350 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 241 - DNA, 642 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 242 - DNA, 1362 bp, Artificial Sequence
  source: /note="Description of Artificial Sequence: Synthetic polynucleotide"
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 243 - DNA, 660 bp, Artificial Sequence
  source: /note="Description of Artificial Sequence: Synthetic polynucleotide"
gacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 244 - DNA, 1347 bp, Artificial Sequence
  source: /note="Description of Artificial Sequence: Synthetic polynucleotide"
gaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 245 - DNA, 642 bp, Artificial Sequence
  source: /note="Description of Artificial Sequence: Synthetic polynucleotide"
gatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaagcggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 246 - DNA, 1350 bp, Artificial Sequence
  source: /note="Description of Artificial Sequence: Synthetic polynucleotide"
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 247 - DNA, 660 bp, Artificial Sequence
  source: /note="Description of Artificial Sequence: Synthetic polynucleotide"
gatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 248 - protein, 258 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSGGSEGKSSGSGSESKSTGGSDIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIK

SEQ ID NO: 249 - protein, 258 aa, Artificial Sequence
  source: /note="Description of Artificial Sequence: Synthetic polypeptide"
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKGGSEGKSSGSGSESKSTGGSQVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSS

SEQ ID NO: 250 - protein, 256 aa, Artificial Sequence
  source: /note="Description of Artificial Sequence: Synthetic polypeptide"
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSGGSEGKSSGSGSESKSTGGSDIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIK

SEQ ID NO: 251 - protein, 256 aa, Artificial Sequence
  source: /note="Description of Artificial Sequence: Synthetic polypeptide"
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKGGSEGKSSGSGSESKSTGGSQVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSS

SEQ ID NO: 252 - protein, 258 aa, Artificial Sequence
  source: /note="Description of Artificial Sequence: Synthetic polypeptide"
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSGGSEGKSSGSGSESKSTGGSDIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIK

SEQ ID NO: 253 - protein, 258 aa, Artificial Sequence
  source: /note="Description of Artificial Sequence: Synthetic polypeptide"
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKGGSEGKSSGSGSESKSTGGSQVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSS

SEQ ID NO: 254 - protein, 254 aa, Artificial Sequence
  source: /note="Description of Artificial Sequence: Synthetic polypeptide"
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSGGSEGKSSGSGSESKSTGGSDIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIK

SEQ ID NO: 255 - protein, 254 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKGGSEGKSSGSGSESKSTGGSQVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSS

SEQ ID NO: 256 - protein, 252 aa, Artificial Sequence
  source: /note="Description of Artificial Sequence: Synthetic polypeptide"
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSGGSEGKSSGSGSESKSTGGSDIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIK

SEQ ID NO: 257 - protein, 252 aa, Artificial Sequence
  source: /note="Description of Artificial Sequence: Synthetic polypeptide"
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKGGSEGKSSGSGSESKSTGGSQLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSS

SEQ ID NO: 258 - protein, 254 aa, Artificial Sequence
  source: /note="Description of Artificial Sequence: Synthetic polypeptide"
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIK

SEQ ID NO: 259 - protein, 254 aa, Artificial Sequence
  source: /note="Description of Artificial Sequence: Synthetic polypeptide"
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKGGSEGKSSGSGSESKSTGGSEVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSS

SEQ ID NO: 260 - protein, 254 aa, Artificial Sequence
  source: /note="Description of Artificial Sequence: Synthetic polypeptide"
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSGGSEGKSSGSGSESKSTGGSDIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIK

SEQ ID NO: 261 - protein, 254 aa, Artificial Sequence
  source: /note="Description of Artificial Sequence: Synthetic polypeptide"
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKGGSEGKSSGSGSESKSTGGSQVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSS

SEQ ID NO: 262 - protein, 247 aa, Artificial Sequence
  source: /note="Description of Artificial Sequence: Synthetic polypeptide"
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIK

SEQ ID NO: 263 - protein, 247 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSS

SEQ ID NO: 264 - protein, 258 aa, Artificial Sequence; identical to SEQ ID NO: 248
  source: /note="Description of Artificial Sequence: Synthetic polypeptide"

SEQ ID NO: 265 - protein, 258 aa, Artificial Sequence; identical to SEQ ID NO: 249
  source: /note="Description of Artificial Sequence: Synthetic polypeptide"

SEQ ID NO: 266 - protein, 247 aa, Artificial Sequence
  source: /note="Description of Artificial Sequence: Synthetic polypeptide"
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIK

SEQ ID NO: 267 - protein, 247 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSS

SEQ ID NO: 268 - protein, 254 aa, Artificial Sequence
  source: /note="Description of Artificial Sequence: Synthetic polypeptide"
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIK

SEQ ID NO: 269 - protein, 254 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKGGSEGKSSGSGSESKSTGGSQVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSS

SEQ ID NO: 270 - protein, 490 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSGGSEGKSSGSGSESKSTGGSDIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 271 - protein, 490 aa, Artificial Sequence
  source: /note="Description of Artificial Sequence: Synthetic polypeptide"
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKGGSEGKSSGSGSESKSTGGSQVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 272 - protein, 488 aa, Artificial Sequence
  source: /note="Description of Artificial Sequence: Synthetic polypeptide"
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSGGSEGKSSGSGSESKSTGGSDIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 273 - protein, 488 aa, Artificial Sequence
  source: /note="Description of Artificial Sequence: Synthetic polypeptide"
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKGGSEGKSSGSGSESKSTGGSQVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 274 - protein, 490 aa, Artificial Sequence
  source: /note="Description of Artificial Sequence: Synthetic polypeptide"
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSGGSEGKSSGSGSESKSTGGSDIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 275 - protein, 490 aa, Artificial Sequence
  source: /note="Description of Artificial Sequence: Synthetic polypeptide"
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKGGSEGKSSGSGSESKSTGGSQVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 276 - protein, 486 aa, Artificial Sequence
  source: /note="Description of Artificial Sequence: Synthetic polypeptide"
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSGGSEGKSSGSGSESKSTGGSDIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 277 - protein, 486 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKGGSEGKSSGSGSESKSTGGSQVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 278 - protein, 484 aa, Artificial Sequence
  source: /note="Description of Artificial Sequence: Synthetic polypeptide"
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSGGSEGKSSGSGSESKSTGGSDIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 279 - protein, 484 aa, Artificial Sequence
  source: /note="Description of Artificial Sequence: Synthetic polypeptide"
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKGGSEGKSSGSGSESKSTGGSQLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 280 - protein, 486 aa, Artificial Sequence
  source: /note="Description of Artificial Sequence: Synthetic polypeptide"
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 281 - protein, 486 aa, Artificial Sequence
  source: /note="Description of Artificial Sequence: Synthetic polypeptide"
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKGGSEGKSSGSGSESKSTGGSEVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 282 - protein, 486 aa, Artificial Sequence
  source: /note="Description of Artificial Sequence: Synthetic polypeptide"
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSGGSEGKSSGSGSESKSTGGSDIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 283 - protein, 486 aa, Artificial Sequence
  source: /note="Description of Artificial Sequence: Synthetic polypeptide"
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKGGSEGKSSGSGSESKSTGGSQVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 284 - protein, 479 aa, Artificial Sequence
  source: /note="Description of Artificial Sequence: Synthetic polypeptide"
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 285 - protein, 479 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 286 - protein, 490 aa, Artificial Sequence; identical to SEQ ID NO: 270
  source: /note="Description of Artificial Sequence: Synthetic polypeptide"

SEQ ID NO: 287 - protein, 490 aa, Artificial Sequence; identical to SEQ ID NO: 271
  source: /note="Description of Artificial Sequence: Synthetic polypeptide"

SEQ ID NO: 288 - protein, 479 aa, Artificial Sequence
  source: /note="Description of Artificial Sequence: Synthetic polypeptide"
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 289 - protein, 479 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 290 - protein, 486 aa, Artificial Sequence
  source: /note="Description of Artificial Sequence: Synthetic polypeptide"
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 291 - protein, 486 aa, Artificial Sequence
  source: /note="Description of Artificial Sequence: Synthetic polypeptide"
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKGGSEGKSSGSGSESKSTGGSQVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 292 - DNA, 774 bp, Artificial Sequence
  source: /note="Description of Artificial Sequence: Synthetic polynucleotide"
caggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcggcggatctgagggaaagtccagcggctccggcagcgaaagcaagtccaccggcggaagcgacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaag

SEQ ID NO: 293 - DNA, 774 bp, Artificial Sequence
  source: /note="Description of Artificial Sequence: Synthetic polynucleotide"
gacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaagggcggatctgagggaaagtccagcggctccggcagcgaaagcaagtccaccggcggaagccaggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagc

SEQ ID NO: 294 - DNA, 768 bp, Artificial Sequence
  source: /note="Description of Artificial Sequence: Synthetic polynucleotide"
caggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaag

SEQ ID NO: 295 - DNA, 768 bp, Artificial Sequence
  source: /note="Description of Artificial Sequence: Synthetic polynucleotide"
gacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaagggcggatctgagggaaagtccagcggctccggcagcgaaagcaagtccaccggcggaagccaggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagc

SEQ ID NO: 296 - DNA, 774 bp, Artificial Sequence
  source: /note="Description of Artificial Sequence: Synthetic polynucleotide"
caggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcggcggatctgagggaaagtccagcggctccggcagcgaaagcaagtccaccggcggaagcgacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaag

SEQ ID NO: 297 - DNA, 774 bp, Artificial Sequence
  source: /note="Description of Artificial Sequence: Synthetic polynucleotide"
gacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaagggcggatctgagggaaagtccagcggctccggcagcgaaagcaagtccaccggcggaagccaggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagc

SEQ ID NO: 298 - DNA, 762 bp, Artificial Sequence
  source: /note="Description of Artificial Sequence: Synthetic polynucleotide"
caggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaag

SEQ ID NO: 299 - DNA, 762 bp, Artificial Sequence
  source: /note="Description of Artificial Sequence: Synthetic polynucleotide"
gacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaagggcggatctgagggaaagtccagcggctccggcagcgaaagcaagtccaccggcggaagccaggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagc

SEQ ID NO: 300 - DNA, 756 bp, Artificial Sequence
  source: /note="Description of Artificial Sequence: Synthetic polynucleotide"
cagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcggcggatctgagggaaagtccagcggctccggcagcgaaagcaagtccaccggcggaagcgacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaag

SEQ ID NO: 301 - DNA, 756 bp, Artificial Sequence
  source: /note="Description of Artificial Sequence: Synthetic polynucleotide"
gacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaagggcggatctgagggaaagtccagcggctccggcagcgaaagcaagtccaccggcggaagccagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagc

SEQ ID NO: 302 - DNA, 762 bp, Artificial Sequence
  source: /note="Description of Artificial Sequence: Synthetic polynucleotide"
gaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcaggcggatctgagggaaagtccagcggctccggcagcgaaagcaagtccaccggcggaagcgacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaa

SEQ ID NO: 303 - DNA, 762 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagcgaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctca

SEQ ID NO: 304 - DNA, 762 bp, Artificial Sequence
  source: /note="Description of Artificial Sequence: Synthetic polynucleotide"
caggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcaggcggatctgagggaaagtccagcggctccggcagcgaaagcaagtccaccggcggaagcgacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaa

SEQ ID NO: 305 - DNA, 762 bp, Artificial Sequence
  source: /note="Description of Artificial Sequence: Synthetic polynucleotide"
gacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagccaggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctca

SEQ ID NO: 306 - DNA, 741 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcaggcggatctgagggaaagtccagcggctccggcagcgaaagcaagtccaccggcggaagcgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaa

SEQ ID NO: 307 - DNA, 741 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaaggcggatctgagggaaagtccagcggctccggcagcgaaagcaagtccaccggcggaagcgaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctca

SEQ ID NO: 308 - DNA, 774 bp, Artificial Sequence
  source: /note="Description of Artificial Sequence: Synthetic polynucleotide"
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccggcggatctgagggaaagtccagcggctccggcagcgaaagcaagtccaccggcggaagcgacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaa

SEQ ID NO: 309 - DNA, 774 bp, Artificial Sequence
  source: /note="Description of Artificial Sequence: Synthetic polynucleotide"
gacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaaggcggatctgagggaaagtccagcggctccggcagcgaaagcaagtccaccggcggaagccaagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatcc

SEQ ID NO: 310 - DNA, 741 bp, Artificial Sequence
  source: /note="Description of Artificial Sequence: Synthetic polynucleotide"
gaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtggcggatctgagggaaagtccagcggctccggcagcgaaagcaagtccaccggcggaagcgatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaag

SEQ ID NO: 311 - DNA, 741 bp, Artificial Sequence
  source: /note="Description of Artificial Sequence: Synthetic polynucleotide"
gatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaagggcggatctgagggaaagtccagcggctccggcagcgaaagcaagtccaccggcggaagcgaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagt

SEQ ID NO: 312 - DNA, 762 bp, Artificial Sequence
  source: /note="Description of Artificial Sequence: Synthetic polynucleotide"
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcaggcggatctgagggaaagtccagcggctccggcagcgaaagcaagtccaccggcggaagcgatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaa

SEQ ID NO: 313 - DNA, 762 bp, Artificial Sequence
  source: /note="Description of Artificial Sequence: Synthetic polynucleotide"
gatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaaggcggatctgagggaaagtccagcggctccggcagcgaaagcaagtccaccggcggaagccaggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctca

SEQ ID NO: 314 - DNA, 1470 bp, Artificial Sequence
  source: /note="Description of Artificial Sequence: Synthetic polynucleotide"
caggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcggcggatctgagggaaagtccagcggctccggcagcgaaagcaagtccaccggcggaagcgacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 315 - DNA, 1470 bp, Artificial Sequence
  source: /note="Description of Artificial Sequence: Synthetic polynucleotide"
gacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaagggcggatctgagggaaagtccagcggctccggcagcgaaagcaagtccaccggcggaagccaggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 316 - DNA, 1464 bp, Artificial Sequence
  source: /note="Description of Artificial Sequence: Synthetic polynucleotide"
caggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 317 - DNA, 1464 bp, Artificial Sequence
  source: /note="Description of Artificial Sequence: Synthetic polynucleotide"
gacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaagggcggatctgagggaaagtccagcggctccggcagcgaaagcaagtccaccggcggaagccaggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 318 - DNA, 1470 bp, Artificial Sequence
  source: /note="Description of Artificial Sequence: Synthetic polynucleotide"
caggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcggcggatctgagggaaagtccagcggctccggcagcgaaagcaagtccaccggcggaagcgacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 319 - DNA, 1470 bp, Artificial Sequence
  source: /note="Description of Artificial Sequence: Synthetic polynucleotide"
gacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaagggcggatctgagggaaagtccagcggctccggcagcgaaagcaagtccaccggcggaagccaggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 320 - DNA, 1458 bp, Artificial Sequence
  source: /note="Description of Artificial Sequence: Synthetic polynucleotide"
caggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 321 - DNA, 1458 bp, Artificial Sequence
  source: /note="Description of Artificial Sequence: Synthetic polynucleotide"
gacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaagggcggatctgagggaaagtccagcggctccggcagcgaaagcaagtccaccggcggaagccaggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 322 - DNA, 1452 bp, Artificial Sequence
  source: /note="Description of Artificial Sequence: Synthetic polynucleotide"
cagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcggcggatctgagggaaagtccagcggctccggcagcgaaagcaagtccaccggcggaagcgacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 323 - DNA, 1452 bp, Artificial Sequence
  source: /note="Description of Artificial Sequence: Synthetic polynucleotide"
gacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaagggcggatctgagggaaagtccagcggctccggcagcgaaagcaagtccaccggcggaagccagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 324 - DNA, 1458 bp, Artificial Sequence
  source: /note="Description of Artificial Sequence: Synthetic polynucleotide"
gaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcaggcggatctgagggaaagtccagcggctccggcagcgaaagcaagtccaccggcggaagcgacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 325 - DNA, 1458 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagcgaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 326 - DNA, 1458 bp, Artificial Sequence
  source: /note="Description of Artificial Sequence: Synthetic polynucleotide"
caggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcaggcggatctgagggaaagtccagcggctccggcagcgaaagcaagtccaccggcggaagcgacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 327 - DNA, 1458 bp, Artificial Sequence
  source: /note="Description of Artificial Sequence: Synthetic polynucleotide"
gacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagccaggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 328 - DNA, 1437 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcaggcggatctgagggaaagtccagcggctccggcagcgaaagcaagtccaccggcggaagcgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 329 - DNA, 1437 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaaggcggatctgagggaaagtccagcggctccggcagcgaaagcaagtccaccggcggaagcgaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 330 - DNA, 1470 bp, Artificial Sequence
  source: /note="Description of Artificial Sequence: Synthetic polynucleotide"
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccggcggatctgagggaaagtccagcggctccggcagcgaaagcaagtccaccggcggaagcgacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 331 - DNA, 1470 bp, Artificial Sequence
  source: /note="Description of Artificial Sequence: Synthetic polynucleotide"
gacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaaggcggatctgagggaaagtccagcggctccggcagcgaaagcaagtccaccggcggaagccaagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 332 - DNA, 1437 bp, Artificial Sequence
  source: /note="Description of Artificial Sequence: Synthetic polynucleotide"
gaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtggcggatctgagggaaagtccagcggctccggcagcgaaagcaagtccaccggcggaagcgatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 333 - DNA, 1437 bp, Artificial Sequence
  source: /note="Description of Artificial Sequence: Synthetic polynucleotide"
gatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaagggcggatctgagggaaagtccagcggctccggcagcgaaagcaagtccaccggcggaagcgaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 334 - DNA, 1458 bp, Artificial Sequence
  source: /note="Description of Artificial Sequence: Synthetic polynucleotide"
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcaggcggatctgagggaaagtccagcggctccggcagcgaaagcaagtccaccggcggaagcgatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 335 - DNA, 1458 bp, Artificial Sequence
  source: /note="Description of Artificial Sequence: Synthetic polynucleotide"
gatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaaggcggatctgagggaaagtccagcggctccggcagcgaaagcaagtccaccggcggaagccaggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 336 - protein, 432 aa, Artificial Sequence
  source: /note="Description of Artificial Sequence: Synthetic polypeptide"
FKIPIEELEDRVFVNCNTSITWVEGTVGTLLSDITRLDLGKRILDPRGIYRCNGTDIYKDKESTVQVHYRMGSADDAKKDAAKKDDAKKDDAKKDGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGLNDIFEAQKIEWHE

SEQ ID NO: 337 - protein, 446 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 338 - protein, 214 aa, Artificial Sequence
  source: /note="Description of Artificial Sequence: Synthetic polypeptide"
DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 116 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 340 - protein, 107 aa, Artificial Sequence
  source: /note="Description of Artificial Sequence: Synthetic polypeptide"
DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK

SEQ ID NO: 341 - protein, 107 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK

SEQ ID NO: 342 - protein, 107 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK

SEQ ID NO: 343 - protein, 107 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK

SEQ ID NO: 344 - protein, 107 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK

SEQ ID NO: 345 - protein, 107 aa, Artificial Sequence
  source: /note="Description of Artificial Sequence: Synthetic polypeptide"
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK

SEQ ID NO: 346 - protein, 120 aa, Artificial Sequence
  source: /note="Description of Artificial Sequence: Synthetic polypeptide"
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS

SEQ ID NO: 347 - protein, 110 aa, Artificial Sequence
  source: /note="Description of Artificial Sequence: Synthetic polypeptide"
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL

SEQ ID NO: 348 - protein, 120 aa, Artificial Sequence
  source: /note="Description of Artificial Sequence: Synthetic polypeptide"
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSS

SEQ ID NO: 349 - protein, 110 aa, Artificial Sequence
  source: /note="Description of Artificial Sequence: Synthetic polypeptide"
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVL

SEQ ID NO: 350 - DNA, 348 bp, Artificial Sequence
  source: /note="Description of Artificial Sequence: Synthetic polynucleotide"
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctca

SEQ ID NO: 351 - DNA, 321 bp, Artificial Sequence
  source: /note="Description of Artificial Sequence: Synthetic polynucleotide"
gatatacttcttacccagagtcccggcatcctctccgttagccctggggagagagtctcattctcatgccgagccagacagtcaattggtaccgcaatacactggtatcaacagcggaccaatggttctccccgacttctgataaagtacgcatcagaatcaattagtggaataccatcaagatttagtggctcagggagtggaaccgattttactctgaccatcaactcagtggaatctgaggacattgccgactactactgtcaacaaagcaatagttggccatataccttcggaggcggaactaaattggagataaaa

SEQ ID NO: 352 - DNA, 321 bp, Artificial Sequence
  source: /note="Description of Artificial Sequence: Synthetic polynucleotide"
gacatccagatgacacagtcaccttctagtttgtctgcttctgtaggcgaccgtgtaactatcacctgtcgagcccgtcaaagtattggtactgccattcactggtaccaacaaaaacctggcaaagctccaaaactcttgatctactatgcctccgaaagcatatcaggggtcccaagcagattctcaggcagtggcagtggcactgacttcactctcaccatttctagcgtgcaaccagaggacttcgccacttattactgccaacagtcagggagctggccctacaccttcggccaaggtacaaaactggagatcaaa

SEQ ID NO: 353 - DNA, 321 bp, Artificial Sequence
  source: /note="Description of Artificial Sequence: Synthetic polynucleotide"
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaag

SEQ ID NO: 354 - DNA, 321 bp, Artificial Sequence
  source: /note="Description of Artificial Sequence: Synthetic polynucleotide"
gacatccaaatgactcaatcacctagcagcctctccgcctccgttggagatagagtgacaataacttgccgagcccggcaaagtatcggaactgctattcactggtatcaacaaaaacctggaaaggcacctaagctcttgattaaatacgcttctgagtccatctccggcgtgccttcacgattcagcggcagcggtagtggtactgactttaccctcactattagttctgttcagccagaggacttcgcaacttattactgccaacagagtggttcctggccatacacttttggccaggggactaaattggaaatcaaa

SEQ ID NO: 355 - DNA, 321 bp, Artificial Sequence
  source: /note="Description of Artificial Sequence: Synthetic polynucleotide"
gacatccaaatgactcaaagcccctctagtttgagtgcatctgtaggtgaccgggtaacaatcacctgccgtgcccggcaaagtataggtactgcaatccactggtaccagcaaaaacccggcaaagcaccaaagctgctcatatactatgctagtgagagcatttctggcgttcctagtcgattttctggatcagggagtggaactgattttacactgacaatcagcagcctccaacccgaagacttcgccacctactattgtcagcagtctgggtcctggccttacacattcggtcaaggaactaaattggagatcaaa

SEQ ID NO: 356 - DNA, 321 bp, Artificial Sequence
  source: /note="Description of Artificial Sequence: Synthetic polynucleotide"
gacattttgctgacacagagccctggtatcctctcagtcagtccaggggaacgcgtttcatttagctgccgtgctcgacagagcattgggaccgcaatccactggtaccaacaaagaactaacggttcaccacggcttttgattaagtatgcctccgaatccatcagtggcattcctagtcgtttttctggatcaggatcaggcaccgactttactctcacaattaatagtgtcgaaagtgaggacattgcagactattattgtcagcaatccggttcctggccctatacttttggtggtggtactaagttggaaattaaa

SEQ ID NO: 357 - DNA, 360 bp, Artificial Sequence
  source: /note="Description of Artificial Sequence: Synthetic polynucleotide"
caggtgcagctgcagcagtctggccctagactcgtgcggccttcccagaccctgtctctgacctgtgccatctccggcgactccgtgttcaacaacaacgccgcctggtcctggatccggcagagcccttctagaggcctggaatggctgggccggacctactaccggtccaagtggctgtacgactacgccgtgtccgtgaagtcccggatcaccgtgaaccctgacacctcccggaaccagttcaccctgcagctgaactccgtgacccctgaggacaccgccctgtactactgcgccagaggctactcctcctccttcgactattggggccagggcaccctcgtgaccgtgtcctct

SEQ ID NO: 358 - DNA, 329 bp, Artificial Sequence
  source: /note="Description of Artificial Sequence: Synthetic polynucleotide"
agtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctg

SEQ ID NO: 359 - DNA, 360 bp, Artificial Sequence
  source: /note="Description of Artificial Sequence: Synthetic polynucleotide"
caagtgcaactccaacaaagcggcccagggctggtaaagccttcacagaccctctcacttacttgcgcaatatctggggactccgtgtttaataacaatgctgcatggagctggattcgccagagcccaagtcgcgggctcgagtggcttggtcgaacctattaccgctccaagtggctctatgactacgcagtaagcgtcaaatcacggataacaatcaaccctgacacatccaagaatcagtttagtctgcaactcaactcagtcacccctgaggataccgcagtgtattattgtgccagagggtacagctcttcctttgattactggggccaaggtacactggtaacagtatcaagc

SEQ ID NO: 360 - DNA, 330 bp, Artificial Sequence
  source: /note="Description of Artificial Sequence: Synthetic polynucleotide"
cagtctgctctgacccagcctgcctccgtgtctggctctcccggccagtccatcaccatcagctgtaccggcacctcctccaacatcggcacctacaagttcgtgtcctggtatcagcagcaccccggcaaggcccccaaagtgatgatctacgaggtgtccaagcggccctccggcgtgtccaacagattctccggctccaagtccggcaacaccgcctccctgacaatcagcggactgcaggccgaggacgaggccgactactactgtgtgtcctacgccggctctggcaccctgctgtttggcggcggaacaaagctgaccgtgctg

SEQ ID NO: 361 - protein, 5 aa, Artificial Sequence
  source: /note="Description of Artificial Sequence: Synthetic peptide"
RYNMN

SEQ ID NO: 362 - protein, 17 aa, Artificial Sequence
  source: /note="Description of Artificial Sequence: Synthetic peptide"
SISTSSNYIYYADSVKG

SEQ ID NO: 363 - protein, 7 aa, Artificial Sequence
  source: /note="Description of Artificial Sequence: Synthetic peptide"
GWGPFDY

SEQ ID NO: 364 - protein, 7 aa, Artificial Sequence
  source: /note="Description of Artificial Sequence: Synthetic peptide"
NNNAAWS

SEQ ID NO: 365 - protein, 18 aa, Artificial Sequence
  source: /note="Description of Artificial Sequence: Synthetic peptide"
RTYYRSKWLYDYAVSVKS

SEQ ID NO: 366 - protein, 8 aa, Artificial Sequence
  source: /note="Description of Artificial Sequence: Synthetic peptide"
GYSSSFDY

SEQ ID NO: 367 - protein, 11 aa, Artificial Sequence
  source: /note="Description of Artificial Sequence: Synthetic peptide"
RARQSIGTAIH

SEQ ID NO: 368 - protein, 7 aa, Artificial Sequence
  source: /note="Description of Artificial Sequence: Synthetic peptide"
YASESIS

SEQ ID NO: 369 - protein, 9 aa, Artificial Sequence
  source: /note="Description of Artificial Sequence: Synthetic peptide"
QQSNSWPYT

SEQ ID NO: 370 - protein, 9 aa, Artificial Sequence
  source: /note="Description of Artificial Sequence: Synthetic peptide"
QQSGSWPYT

SEQ ID NO: 371 - protein, 14 aa, Artificial Sequence
  source: /note="Description of Artificial Sequence: Synthetic peptide"
TGTSSNIGTYKFVS

SEQ ID NO: 372 - protein, 7 aa, Artificial Sequence
  source: /note="Description of Artificial Sequence: Synthetic peptide"
EVSKRPS

SEQ ID NO: 373 - protein, 10 aa, Artificial Sequence
  source: /note="Description of Artificial Sequence: Synthetic peptide"
VSYAGSGTLL

SEQ ID NO: 374 - protein, 107 aa, Artificial Sequence
  source: /note="Description of Artificial Sequence: Synthetic polypeptide"
  VARIANT (4)..(4): /replace="Met"
  VARIANT (9)..(9): /replace="Ser"
  VARIANT (10)..(10): /replace="Ser"
  VARIANT (13)..(13): /replace="Ala"
  VARIANT (15)..(15): /replace="Val"
  VARIANT (17)..(17): /replace="Asp"
  VARIANT (20)..(20): /replace="Thr"
  VARIANT (21)..(21): /replace="Ile"
  VARIANT (22)..(22): /replace="Thr"
  VARIANT (40)..(40): /replace="Pro"
  VARIANT (41)..(41): /replace="Gly"
  VARIANT (42)..(42): /replace="Lys"
  VARIANT (43)..(43): /replace="Ala"
  VARIANT (45)..(45): /replace="Lys"
  VARIANT (49)..(49): /replace="Tyr"
  VARIANT (58)..(58): /replace="Val"
  VARIANT (76)..(76): /replace="Ser"
  VARIANT (78)..(78): /replace="Leu"
  VARIANT (80)..(80): /replace="Pro"
  VARIANT (83)..(83): /replace="Phe"
  VARIANT (85)..(85): /replace="Thr"
  VARIANT (92)..(92): /replace="Gly"
  VARIANT (100)..(100): /replace="Gln"
  SITE (1)..(107): /note="Variant residues given in the sequence have no preference with respect to those in the annotations for variant positions"
DIQLTQSPGILSVSPGERVSFSCRARQSIGTAIHWYQQKTNGSPRLLIKYASESISGIPSRFSGSGSGTDFTLTINSVQSEDIADYYCQQSNSWPYTFGGGTKLEIK

SEQ ID NO: 375 - protein, 805 aa, Artificial Sequence
  source: /note="Description of Artificial Sequence: Synthetic polypeptide"
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGGGSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSHHHHHHHH

SEQ ID NO: 376 - protein, 16 aa, Artificial Sequence
  source: /note="Description of Artificial Sequence: Synthetic peptide"
GTEGKSSGSGSESKST

SEQ ID NO: 377 - protein, 426 aa, Artificial Sequence
  source: /note="Description of Artificial Sequence: Synthetic polypeptide"
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGSGSLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTFPPSQEEMTKNQVSLRCLVKGFYPSDIAVEWESNGQPENNYKTTKPVLDSDGSFRLESRLTVDKSRWQEGNVFSCSVMHEALHNHYTQKSLSLSGGHHHHHH

SEQ ID NO: 378 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIKGPGGQHHHHHHGAYPYDVPDYAS

SEQ ID NO: 379 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSLQPEDFATYYCQQSNSWPYTFGQGTKLEIKGPGGQHHHHHHGAYPYDVPDYAS

SEQ ID NO: 380 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSLQPEDFATYYCQQSNSWPYTFGQGTKLEIKGPGGQHHHHHHGAYPYDVPDYAS

SEQ ID NO: 381 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSVQPEDFATYYCQQSNSWPYTFGQGTKLEIKGPGGQHHHHHHGAYPYDVPDYAS

SEQ ID NO: 382 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGPGGQHHHHHHGAYPYDVPDYAS

SEQ ID NO: 383 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGPGGQHHHHHHGAYPYDVPDYAS

SEQ ID NO: 384 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGPGGQHHHHHHGAYPYDVPDYAS

SEQ ID NO: 385 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGPGGQHHHHHHGAYPYDVPDYAS

SEQ ID NO: 386 - protein, 262 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGPGGQHHHHHHGAYPYDVPDYAS

SEQ ID NO: 387 - protein, 231 aa, Artificial Sequence
  source: /note="Description of Artificial Sequence: Synthetic polypeptide"
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 388 - protein, 243 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK

SEQ ID NO: 389 - protein, 243 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 390 - protein, 243 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK

SEQ ID NO: 391 - protein, 243 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 392 - protein, 243 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK

SEQ ID NO: 393 - protein, 243 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 394 - protein, 243 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK

SEQ ID NO: 395 - protein, 243 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 396 - protein, 243 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK

SEQ ID NO: 397 - protein, 243 aa, Artificial Sequence
  source: /note="Description of Artificial Sequence: Synthetic polypeptide"
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 398 - protein, 250 aa, Artificial Sequence
  source: /note="Description of Artificial Sequence: Synthetic polypeptide"
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVLGGSEGKSSGSGSESKSTGGSQVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSS

SEQ ID NO: 399 - protein, 254 aa, Artificial Sequence
  source: /note="Description of Artificial Sequence: Synthetic polypeptide"
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGSEGKSSGSGSESKSTGGSEVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCVRHGNFGNSYVSWFAYWGQGTLVTVSS

SEQ ID NO: 400 - protein, 244 aa, Artificial Sequence
  source: /note="Description of Artificial Sequence: Synthetic polypeptide"
DIQMTQSPSSLSASVGDRVTITCRASQSISSYLNWYQQKPGCAPKLLIYAASSLQSGVPSRFSGSGSGTDFTLTISSLQPEDFATYYCQQSYSTPLTFGQGTKVEIKGGGSGGSGGCPPCGGSGGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYDGIYGELDFWGCGTLVTVSS

SEQ ID NO: 401 - protein, 475 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 402 - protein, 475 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 403 - protein, 475 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 404 - protein, 475 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 405 - protein, 474 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 406 - protein, 475 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 407 - protein, 475 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 408 - protein, 475 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 409 - protein, 475 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 410 - protein, 475 aa, Artificial Sequence
  source: /note="Description of Artificial Sequence: Synthetic polypeptide"
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 411 - protein, 481 aa, Artificial Sequence
  source: /note="Description of Artificial Sequence: Synthetic polypeptide"
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVLGGSEGKSSGSGSESKSTGGSQVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 412 - protein, 485 aa, Artificial Sequence
  source: /note="Description of Artificial Sequence: Synthetic polypeptide"
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGSEGKSSGSGSESKSTGGSEVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCVRHGNFGNSYVSWFAYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 413 - protein, 475 aa, Artificial Sequence
  source: /note="Description of Artificial Sequence: Synthetic polypeptide"
DIQMTQSPSSLSASVGDRVTITCRASQSISSYLNWYQQKPGCAPKLLIYAASSLQSGVPSRFSGSGSGTDFTLTISSLQPEDFATYYCQQSYSTPLTFGQGTKVEIKGGGSGGSGGCPPCGGSGGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYDGIYGELDFWGCGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 414 - DNA, 729 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaag

SEQ ID NO: 415 - DNA, 729 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 416 - DNA, 729 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaag

SEQ ID NO: 417 - DNA, 729 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 418 - DNA, 729 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaag

SEQ ID NO: 419 - DNA, 729 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 420 - DNA, 729 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaag

SEQ ID NO: 421 - DNA, 729 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 422 - DNA, 729 bp, Artificial Sequence
  source: /note="Description of Artificial Sequence: Synthetic polynucleotide"
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggatctgagggaaagtccagcggctccggcagcgaaagcaagtccaccggcggaagcgacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaa

SEQ ID NO: 423 - DNA, 729 bp, Artificial Sequence
  source: /note="Description of Artificial Sequence: Synthetic polynucleotide"
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaaggcggatctgagggaaagtccagcggctccggcagcgaaagcaagtccaccggcggaagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctca

SEQ ID NO: 424 - DNA, 750 bp, Artificial Sequence
  source: /note="Description of Artificial Sequence: Synthetic polynucleotide"
cagtctgctctgacccagcctgcctccgtgtctggctctcccggccagtccatcaccatcagctgtaccggcacctcctccaacatcggcacctacaagttcgtgtcctggtatcagcagcaccccggcaaggcccccaaagtgatgatctacgaggtgtccaagcggccctccggcgtgtccaacagattctccggctccaagtccggcaacaccgcctccctgacaatcagcggactgcaggccgaggacgaggccgactactactgtgtgtcctacgccggctctggcaccctgctgtttggcggcggaacaaagctgaccgtgctgggcggctccgagggcaagagcagcggcagcggcagcgagagcaagagcaccggcggcagccaagtgcaactccaacaaagcggcccagggctggtaaagccttcacagaccctctcacttacttgcgcaatatctggggactccgtgtttaataacaatgctgcatggagctggattcgccagagcccaagtcgcgggctcgagtggcttggtcgaacctattaccgctccaagtggctctatgactacgcagtaagcgtcaaatcacggataacaatcaaccctgacacatccaagaatcagtttagtctgcaactcaactcagtcacccctgaggataccgcagtgtattattgtgccagagggtacagctcttcctttgattactggggccaaggtacactggtaacagtatcaagc

SEQ ID NO: 425 - DNA, 762 bp, Artificial Sequence
  source: /note="Description of Artificial Sequence: Synthetic polynucleotide"
cagacagtggtgacccaggaacctagcctcaccgtgagccccggaggaaccgtgaccctgacctgcagaagcagcaccggcgccgtgaccaccagcaactacgccaactgggtgcagcagaaacctggccaggcccctagaggcctgattggcggcaccaataagagggcccccggaacccctgccaggtttagcggcagcctgctgggcggcaaggctgctctgaccctgtccggagtgcagcccgaggatgaggccgagtactactgcgccctgtggtacagcaacctctgggtgttcggcggcggcacaaagctgaccgtgctcggcggctccgagggcaagagcagcggcagcggcagcgagagcaagagcaccggcggcagcgaagtgcagctggtggagagcggaggaggactggtgcagcccggaggaagcctgagactgagctgcgccgccagcggctttaccttcaacacctacgccatgaactgggtgagacaggcccccggaaagggcctggaatgggtcgccaggatcaggtccaagtacaacaactacgccacctactacgctgccagcgtgaagggcaggttcaccatcagcagggacgacagcaagaacagcctgtacctgcagatgaactccctgaagaccgaggacaccgccgtgtactactgcgtgaggcacggaaacttcggcaacagctacgtgagctggttcgcctactggggccaaggcacactggtcacagtgtccagc

SEQ ID NO: 426 - DNA, 1425 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 427 - DNA, 1425 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 428 - DNA, 1425 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 429 - DNA, 1425 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 430 - DNA, 1425 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 431 - DNA, 1425 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 432 - DNA, 1425 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 433 - DNA, 1425 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 434 - DNA, 1425 bp, Artificial Sequence
  source: /note="Description of Artificial Sequence: Synthetic polynucleotide"
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggatctgagggaaagtccagcggctccggcagcgaaagcaagtccaccggcggaagcgacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 435 - DNA, 1425 bp, Artificial Sequence
  source: /note="Description of Artificial Sequence: Synthetic polynucleotide"
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaaggcggatctgagggaaagtccagcggctccggcagcgaaagcaagtccaccggcggaagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 436 - DNA, 1443 bp, Artificial Sequence
  source: /note="Description of Artificial Sequence: Synthetic polynucleotide"
cagtctgctctgacccagcctgcctccgtgtctggctctcccggccagtccatcaccatcagctgtaccggcacctcctccaacatcggcacctacaagttcgtgtcctggtatcagcagcaccccggcaaggcccccaaagtgatgatctacgaggtgtccaagcggccctccggcgtgtccaacagattctccggctccaagtccggcaacaccgcctccctgacaatcagcggactgcaggccgaggacgaggccgactactactgtgtgtcctacgccggctctggcaccctgctgtttggcggcggaacaaagctgaccgtgctgggcggctccgagggcaagagcagcggcagcggcagcgagagcaagagcaccggcggcagccaagtgcaactccaacaaagcggcccagggctggtaaagccttcacagaccctctcacttacttgcgcaatatctggggactccgtgtttaataacaatgctgcatggagctggattcgccagagcccaagtcgcgggctcgagtggcttggtcgaacctattaccgctccaagtggctctatgactacgcagtaagcgtcaaatcacggataacaatcaaccctgacacatccaagaatcagtttagtctgcaactcaactcagtcacccctgaggataccgcagtgtattattgtgccagagggtacagctcttcctttgattactggggccaaggtacactggtaacagtatcaagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 437 - DNA, 1455 bp, Artificial Sequence
  source: /note="Description of Artificial Sequence: Synthetic polynucleotide"
cagacagtggtgacccaggaacctagcctcaccgtgagccccggaggaaccgtgaccctgacctgcagaagcagcaccggcgccgtgaccaccagcaactacgccaactgggtgcagcagaaacctggccaggcccctagaggcctgattggcggcaccaataagagggcccccggaacccctgccaggtttagcggcagcctgctgggcggcaaggctgctctgaccctgtccggagtgcagcccgaggatgaggccgagtactactgcgccctgtggtacagcaacctctgggtgttcggcggcggcacaaagctgaccgtgctcggcggctccgagggcaagagcagcggcagcggcagcgagagcaagagcaccggcggcagcgaagtgcagctggtggagagcggaggaggactggtgcagcccggaggaagcctgagactgagctgcgccgccagcggctttaccttcaacacctacgccatgaactgggtgagacaggcccccggaaagggcctggaatgggtcgccaggatcaggtccaagtacaacaactacgccacctactacgctgccagcgtgaagggcaggttcaccatcagcagggacgacagcaagaacagcctgtacctgcagatgaactccctgaagaccgaggacaccgccgtgtactactgcgtgaggcacggaaacttcggcaacagctacgtgagctggttcgcctactggggccaaggcacactggtcacagtgtccagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 438 - protein, 446 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 439 - protein, 450 aa, Artificial Sequence
  source: /note="Description of Artificial Sequence: Synthetic polypeptide"
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 440 - protein, 450 aa, Artificial Sequence
  source: /note="Description of Artificial Sequence: Synthetic polypeptide"
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 441 - protein, 454 aa, Artificial Sequence
  source: /note="Description of Artificial Sequence: Synthetic polypeptide"
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 442 - protein, 214 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 214 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 444 - protein, 214 aa, Artificial Sequence
  source: /note="Description of Artificial Sequence: Synthetic polypeptide"
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - protein, 214 aa, Artificial Sequence
  source: /note="Description of Artificial Sequence: Synthetic polypeptide"
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 214 aa, Artificial Sequence
  source: /note="Description of Artificial Sequence: Synthetic polypeptide"
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 447 - protein, 216 aa, Artificial Sequence
  source: /note="Description of Artificial Sequence: Synthetic polypeptide"
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 448 - protein, 216 aa, Artificial Sequence
  source: /note="Description of Artificial Sequence: Synthetic polypeptide"
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 449 - protein, 215 aa, Artificial Sequence
  source: /note="Description of Artificial Sequence: Synthetic polypeptide"
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 450 - DNA, 1338 bp, Artificial Sequence
  source: /note="Description of Artificial Sequence: Synthetic polynucleotide"
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 451 - DNA, 1350 bp, Artificial Sequence
  source: /note="Description of Artificial Sequence: Synthetic polynucleotide"
caggtgcagctccaacagagtggtcccagactcgtgagaccctctcaaacactcagtttgacttgtgccatctcaggcgattcagttttcaacaacaatgcagcttggagctggattaggcagtcacctagtcgcggtcttgaatggcttgggcgtacatactatcgctctaaatggttgtatgattacgctgtgtccgtgaagagccgaatcaccgtaaaccctgatacctccaggaatcagttcacattgcaactgaatagtgtgactcccgaggatactgcactctattattgtgcccgaggatatagcagtagcttcgactattggggacaagggacactcgttaccgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 452 - DNA, 1350 bp, Artificial Sequence
  source: /note="Description of Artificial Sequence: Synthetic polynucleotide"
caagtgcaactccaacaaagcggcccagggctggtaaagccttcacagaccctctcacttacttgcgcaatatctggggactccgtgtttaataacaatgctgcatggagctggattcgccagagcccaagtcgcgggctcgagtggcttggtcgaacctattaccgctccaagtggctctatgactacgcagtaagcgtcaaatcacggataacaatcaaccctgacacatccaagaatcagtttagtctgcaactcaactcagtcacccctgaggataccgcagtgtattattgtgccagagggtacagctcttcctttgattactggggccaaggtacactggtaacagtatcaagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 453 - DNA, 1362 bp, Artificial Sequence
  source: /note="Description of Artificial Sequence: Synthetic polynucleotide"
gaagtgcagctggtggagagcggaggaggactggtgcagcccggaggaagcctgagactgagctgcgccgccagcggctttaccttcaacacctacgccatgaactgggtgagacaggcccccggaaagggcctggaatgggtcgccaggatcaggtccaagtacaacaactacgccacctactacgctgccagcgtgaagggcaggttcaccatcagcagggacgacagcaagaacagcctgtacctgcagatgaactccctgaagaccgaggacaccgccgtgtactactgcgtgaggcacggaaacttcggcaacagctacgtgagctggttcgcctactggggccaaggcacactggtcacagtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 454 - DNA, 642 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 455 - DNA, 642 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 456 - DNA, 642 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 457 - DNA, 642 bp, Artificial Sequence
  source: /note="Description of Artificial Sequence: Synthetic polynucleotide"
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 458 - DNA, 642 bp, Artificial Sequence
  source: /note="Description of Artificial Sequence: Synthetic polynucleotide"
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 459 - DNA, 648 bp, Artificial Sequence
  source: /note="Description of Artificial Sequence: Synthetic polynucleotide"
cagtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 460 - DNA, 648 bp, Artificial Sequence
  source: /note="Description of Artificial Sequence: Synthetic polynucleotide"
cagtctgctctgacccagcctgcctccgtgtctggctctcccggccagtccatcaccatcagctgtaccggcacctcctccaacatcggcacctacaagttcgtgtcctggtatcagcagcaccccggcaaggcccccaaagtgatgatctacgaggtgtccaagcggccctccggcgtgtccaacagattctccggctccaagtccggcaacaccgcctccctgacaatcagcggactgcaggccgaggacgaggccgactactactgtgtgtcctacgccggctctggcaccctgctgtttggcggcggaacaaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 461 - DNA, 645 bp, Artificial Sequence
  source: /note="Description of Artificial Sequence: Synthetic polynucleotide"
cagaccgtcgtgacccaggaacctagcctgaccgtgtctcctggcggcaccgtgaccctgacctgcagatcttctacaggcgccgtgaccaccagcaactacgccaactgggtgcagcagaagccaggccaggctcccagaggactgatcggcggcaccaacaagagagcccctggcacccctgccagattcagcggatctctgctgggaggaaaggccgccctgacactgtctggcgtgcagcctgaagatgaggccgagtactactgcgccctgtggtacagcaacctgtgggtgttcggcggaggcaccaagctgacagtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 462 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 463 - protein, 107 aa, Artificial Sequence [sequence omitted]

SEQ ID NO: 464 - protein, 106 aa, Artificial Sequence
  source: /note="Description of Artificial Sequence: Synthetic polypeptide"
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 465 - protein, 454 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 466 - protein, 450 aa, Artificial Sequence
  source: /note="Description of Artificial Sequence: Synthetic polypeptide"
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 467 - protein, 450 aa, Artificial Sequence; identical to SEQ ID NO: 466
  source: /note="Description of Artificial Sequence: Synthetic polypeptide"

SEQ ID NO: 468 - protein, 220 aa, Artificial Sequence; identical to SEQ ID NO: 215
  source: /note="Description of Artificial Sequence: Synthetic polypeptide"

SEQ ID NO: 469 - protein, 220 aa, Artificial Sequence; identical to SEQ ID NO: 225
  source: /note="Description of Artificial Sequence: Synthetic polypeptide"

SEQ ID NO: 470 - protein, 220 aa, Artificial Sequence; identical to SEQ ID NO: 225
  source: /note="Description of Artificial Sequence: Synthetic polypeptide"

SEQ ID NO: 471 - DNA, 1362 bp, Artificial Sequence
  source: /note="Description of Artificial Sequence: Synthetic polynucleotide"
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 472 - DNA, 660 bp, Artificial Sequence; identical to SEQ ID NO: 243
  source: /note="Description of Artificial Sequence: Synthetic polynucleotide"

SEQ ID NO: 473 - DNA, 1350 bp, Artificial Sequence
  source: /note="Description of Artificial Sequence: Synthetic polynucleotide"
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 474 - DNA, 660 bp, Artificial Sequence; identical to SEQ ID NO: 247
  source: /note="Description of Artificial Sequence: Synthetic polynucleotide"

SEQ ID NO: 475 - DNA, 1350 bp, Artificial Sequence; identical to SEQ ID NO: 473
  source: /note="Description of Artificial Sequence: Synthetic polynucleotide"

SEQ ID NO: 476 - DNA, 660 bp, Artificial Sequence; identical to SEQ ID NO: 247
  source: /note="Description of Artificial Sequence: Synthetic polynucleotide"

SEQ ID NO: 477 - protein, 231 aa, Artificial Sequence
  source: /note="Description of Artificial Sequence: Synthetic polypeptide"
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 478 - protein, 489 aa, Artificial Sequence
  source: /note="Description of Artificial Sequence: Synthetic polypeptide"
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKGGSEGKSSGSGSESKSTGGSQVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 479 - protein, 478 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 480 - DNA, 1470 bp, Artificial Sequence
  source: /note="Description of Artificial Sequence: Synthetic polynucleotide"
gacatcgtgatgacccagtctccagacagcctggctgtgtctctgggcgagagagctaccatcaactgcaagtccagccagtccgtgctgcactcctccaacaacaagaactacctgacctggttccagcagaagcccggccagcctcctaagctgctgatctactgggcctccacccgcgagtctggtgtgcccgatagattctccggctctggctctggcaccgactttaccctgacaatcagctccctgcaggccgaggatgtggccgtgtactactgccaccagtactacagcacccctcctacctttggccagggcaccaaggtggaaatcaagggcggatctgagggaaagtccagcggctccggcagcgaaagcaagtccaccggcggaagccaggttcagctgcagcagtctggccctggactggtcaagccctctcagaccctgtctctgacctgtgccatctccggcgactccgtgtcctctaattctgccgcctggaactggatccggcagtctcctagtagaggcctggaatggctgggcagaacctactaccggtccaagtggtacaacgactacgccgtgtccgtgaagtcccggatcaccatcaatcccgacacctccaagaaccagatctccctgcagctcaacagcgtgacccctgaggataccgccgtgtactactgtgccggcgatcggagatatggcatcgtgggcctgccttttgcttactggggacagggcacactggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 481 - DNA, 1434 bp, Artificial Sequence
  source: /note="Description of Artificial Sequence: Synthetic polynucleotide"
gatattcagatgacccaatcccccagtacccttagtgctagtgtgggagaccgagtgaccattacctgcagagcatcccaatccataagctcctggctcgcctggtatcagcaaaagccaggcaaggcacctaagctgcttatttacaaagcatcctcattggagtccggcgtaccctcacgtttctctggctcaggctccgggacagagtttacattgaccatctctagccttcagccagatgactttgctacatactattgtcaacaatataacagctactctctgaccttcgggggtgggaccaaagtggatattaaaggcggctccgagggcaagagcagcggcagcggcagcgagagcaagagcaccggcggcagcgaagtccaacttcttgagagtggtggtggcctcgtccagccaggaggttctctccggctctcatgtgctgcaagtggctttactttcagctcttacgccatgcactgggtgcgacaggctcccgggaagggtcttgagtgggtgtctggtataagtggttcaggcttttcaacctactatgtcgattccgtcaagggccggtttacaatttcaagggacaattctaagaatacactgtatctccaaatgaatagtctcagagccgaagataccgccgtttactactgcgccaaagataatcttgtggctgggactgtcttcgactattggggtcagggtacattggtaaccgtaagtagtgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 482 - protein, 449 aa, Artificial Sequence
  source: /note="Description of Artificial Sequence: Synthetic polypeptide"
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 483 - protein, 218 aa, Artificial Sequence
  source: /note="Description of Artificial Sequence: Synthetic polypeptide"
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 484 - protein, 91 aa, Artificial Sequence
  source: /note="Description of Artificial Sequence: Synthetic polypeptide"
QDGNEEMGGITQTPYKVSISGTTVILTCPQYPGSEILWQHNDKNIGGDEDDKNIGSDEDHLSLKEFSELEQSGYYVCYPRGSKPEDANFYL

SEQ ID NO: 485 - protein, 8 aa, Homo sapiens
HHPVFDYE

SEQ ID NO: 486 - protein, 330 aa, Homo sapiens [sequence omitted]

SEQ ID NO: 487 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 488 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 489 - protein, 449 aa, Artificial Sequence
  source: /note="Description of Artificial Sequence: Synthetic polypeptide"
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 490 - protein, 490 aa, Artificial Sequence; identical to SEQ ID NO: 271
  source: /note="Description of Artificial Sequence: Synthetic polypeptide"

SEQ ID NO: 491 - protein, 445 aa, Artificial Sequence
  source: /note="Description of Artificial Sequence: Synthetic polypeptide"
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 492 - protein, 232 aa, Artificial Sequence
  source: /note="Description of Artificial Sequence: Synthetic polypeptide"
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 493 - protein, 329 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 494 - protein, 329 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 495 - protein, 232 aa, Artificial Sequence
  source: /note="Description of Artificial Sequence: Synthetic polypeptide"
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 496 - protein, 8 aa, Artificial Sequence
  source: /note="Description of Artificial Sequence: Synthetic peptide"
YYSTPRMY

SEQ ID NO: 497 - protein, 92 aa, Homo sapiens
DPPKTHVTHHPVFDYEATLRCWALGFYPAEIILTWQRDGEDQTQDVELVETRPAGDGTFQKWAAVVVPSGEEQRYTCHVQHEGLPEPLMLRW

SEQ ID NO: 498 - DNA, 1467 bp, Artificial Sequence
  source: /note="Description of Artificial Sequence: Synthetic polynucleotide"
gacatcgtgatgacccagtctccagacagcctggctgtgtctctgggcgagagagctaccatcaactgcaagtccagccagtccgtgctgcactcctccaacaacaagaactacctgacctggttccagcagaagcccggccagcctcctaagctgctgatctactgggcctccacccgcgagtctggtgtgcccgatagattctccggctctggctctggcaccgactttaccctgacaatcagctccctgcaggccgaggatgtggccgtgtactactgccaccagtactacagcacccctcctacctttggccagggcaccaaggtggaaatcaagggcggatctgagggaaagtccagcggctccggcagcgaaagcaagtccaccggcggaagccaggttcagctgcagcagtctggccctggactggtcaagccctctcagaccctgtctctgacctgtgccatctccggcgactccgtgtcctctaattctgccgcctggaactggatccggcagtctcctagtagaggcctggaatggctgggcagaacctactaccggtccaagtggtacaacgactacgccgtgtccgtgaagtcccggatcaccatcaatcccgacacctccaagaaccagatctccctgcagctcaacagcgtgacccctgaggataccgccgtgtactactgtgccggcgatcggagatatggcatcgtgggcctgccttttgcttactggggacagggcacactggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccggga

SEQ ID NO: 499 - DNA, 1347 bp, Artificial Sequence
  source: /note="Description of Artificial Sequence: Synthetic polynucleotide"
caggtgcagctccaacagagtggtcccagactcgtgagaccctctcaaacactcagtttgacttgtgccatctcaggcgattcagttttcaacaacaatgcagcttggagctggattaggcagtcacctagtcgcggtcttgaatggcttgggcgtacatactatcgctctaaatggttgtatgattacgctgtgtccgtgaagagccgaatcaccgtaaaccctgatacctccaggaatcagttcacattgcaactgaatagtgtgactcccgaggatactgcactctattattgtgcccgaggatatagcagtagcttcgactattggggacaagggacactcgttaccgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

We claim:

1. An isolated protein comprising an antigen binding domain that binds human leukocyte antigen G (HLA-G), wherein the antigen binding domain that binds HLA-G comprises
   a) a heavy chain complementarity determining region (HCDR) 1, a HCDR2 and a HCDR3 of a heavy chain variable region (VH) of SEQ ID NO: 50 and a light chain complementarity determining region (LCDR) 1, a LCDR2 and a LCDR3 of a light chain variable region (VL) of SEQ ID NO: 51; or
   b) the HCDR1, the HCDR2 and the HCDR3 of the VH of SEQ ID NO: 52 and the LCDR1, the LCDR2 and the LCDR3 of the VL of SEQ ID NO: 53; or
   c) the HCDR1, the HCDR2 and the HCDR3 of the VH of SEQ ID NO: 54 and the LCDR1, the LCDR2 and the LCDR3 of the VL of SEQ ID NO: 55; or
   d) the HCDR1, the HCDR2 and the HCDR3 of the VH of SEQ ID NO: 56 and the LCDR1, the LCDR2 and the LCDR3 of the VL of SEQ ID NO: 57; or
   e) the HCDR1, the HCDR2 and the HCDR3 of the VH of SEQ ID NO: 58 and the LCDR1, the LCDR2 and the LCDR3 of the VL of SEQ ID NO: 59; or
   f) the HCDR1, the HCDR2 and the HCDR3 of the VH of SEQ ID NO: 60 and the LCDR1, the LCDR2 and the LCDR3 of the VL of SEQ ID NO: 61; or
   g) the HCDR1, the HCDR2 and the HCDR3 of the VH of SEQ ID NO: 62 and the LCDR1, the LCDR2 and the LCDR3 of the VL of SEQ ID NO: 63; or
   h) the HCDR1, the HCDR2 and the HCDR3 of the VH of SEQ ID NO: 64 and the LCDR1, the LCDR2 and the LCDR3 of the VL of SEQ ID NO: 65; or
   i) the HCDR1, the HCDR2 and the HCDR3 of the VH of SEQ ID NO: 66 and the LCDR1, the LCDR2 and the LCDR3 of the VL of SEQ ID NO: 67; or
   j) the HCDR1, the HCDR2 and the HCDR3 of the VH of SEQ ID NO: 68 and the LCDR1, the LCDR2 and the LCDR3 of the VL of SEQ ID NO: 69.

2. The isolated protein of claim 1, comprising the HCDR1, the HCDR2, the HCDR3, the LCDR1, the LCDR2 and the LCDR3 of
   a) SEQ ID NOs: 70, 71, 72, 88, 89, and 90, respectively;
   b) SEQ ID NOs: 73, 71, 74, 91, 89, and 92, respectively;
   c) SEQ ID NOs: 75, 76, 77, 93, 89, and 94, respectively;
   d) SEQ ID NOs: 78, 79, 80, 95, 89, and 96, respectively;
   e) SEQ ID NOs: 81, 82, 83, 97, 89, and 98, respectively;
   f) SEQ ID NOs: 78, 71, 84, 99, 89, and 100, respectively;
   g) SEQ ID NOs: 78, 71, 84, 101, 89, and 100, respectively;
   h) SEQ ID NOs: 85, 86, 87, 102, 103, and 104, respectively; or
   i) SEQ ID NOs: 78, 71, 84, 95, 89, and 96, respectively.

3. The isolated protein of claim 1, wherein the antigen binding domain that binds HLA-G is a scFv or a Fab.

4. The isolated protein of claim 3, wherein the scFv comprises, from the N- to C-terminus, a VH, a first linker (L1) and a VL (VH-L1-VL) or the VL, the L1 and the VH (VL-L1-VH).

5. The isolated protein of claim 4 wherein the L1 comprises the amino acid sequence of SEQ ID NO: 8.

6. The isolated protein of claim 1, wherein the antigen binding domain that binds HLA-G comprises the VH of SEQ ID NOs: 50, 52, 54, 56, 58, 60, 62, 64, 66, or 68 and the VL of SEQ ID NOs: 51, 53, 55, 57, 59, 61, 63, 65, 67, or 69.

7. The isolated protein of claim 6, wherein the antigen binding domain that binds HLA-G comprises:
   a) the VH of SEQ ID NO: 50 and the VL of SEQ ID NO: 51;
   b) the VH of SEQ ID NO: 52 and the VL of SEQ ID NO: 53;
   c) the VH of SEQ ID NO: 54 and the VL of SEQ ID NO: 55;
   d) the VH of SEQ ID NO: 56 and the VL of SEQ ID NO: 57;
   e) the VH of SEQ ID NO: 58 and the VL of SEQ ID NO: 59;
   f) the VH of SEQ ID NO: 60 and the VL of SEQ ID NO: 61;
   g) the VH of SEQ ID NO: 62 and the VL of SEQ ID NO: 63;
   h) the VH of SEQ ID NO: 64 and the VL of SEQ ID NO: 65;
   l) the VH of SEQ ID NO: 66 and the VL of SEQ ID NO: 67; or J) the VH of SEQ ID NO: 68 and the VL of SEQ ID NO: 69.

8. The isolated protein of claim 6, wherein the antigen binding domain that binds HLA-G comprises the amino acid sequence of SEQ ID NOs: 265, 248, 249, 250, 251, 252, 253, 254, 255, 256, 257, 258, 259,260,261,262,263,264,, 266, 267, 268, or 269.

9. The isolated protein of claim 1, wherein the protein is a bispecific protein.

10. The isolated protein of claim 9, further comprising an Fc region.

11. The isolated protein of claim 9, wherein the bispecific protein comprises an antigen binding domain that binds CD3ε.

12. The isolated protein of claim 11, wherein the antigen binding domain that binds CD3ε comprises:
   a) the HCDR1 of SEQ ID NO: 364, the HCDR2 of SEQ ID NO: 365, the HCDR3 of SEQ ID NO: 366, the LCDR1 of SEQ ID NO: 371, the LCDR2 of SEQ ID NO: 372 and the LCDR3 of SEQ ID NO: 373;
   b) the VH of SEQ ID NO: 346 and the VL of SEQ ID NO: 347;
   c) the VH of SEQ ID NO: 348 and the VL of SEQ ID NO: 349;
   d) a heavy chain complementarity determining region 1 (HCDR1) of SEQ ID NO: 361, a HCDR2 of SEQ ID NO: 362, a HCDR3 of SEQ ID NO: 363, a light chain complementarity determining region 1 (LCDR1) of SEQ ID NO: 367, a LCDR2 of SEQ ID NO: 368 and a LCDR3 of SEQ ID NO: 369;
   e) the VH of SEQ ID NO: 339 and the VL of SEQ ID NO: 340;
   f) the HCDR1 of SEQ ID NO: 361, the HCDR2 of SEQ ID NO: 362, the HCDR3 of SEQ ID NO: 363, the LCDR1 of SEQ ID NO: 367, the LCDR2 of SEQ ID NO: 368 and the LCDR3 of SEQ ID NO: 370;
   g) the VH of SEQ ID NO: 339 and the VL of SEQ ID NO: 341;
   h) the VH of SEQ ID NO: 339 and the VL of SEQ ID NO: 342;
   i) the VH of SEQ ID NO: 339 and the VL of SEQ ID NO: 343;
   j) the VH of SEQ ID NO: 339 and the VL of SEQ ID NO: 344; or
   k) the VH of SEQ ID NO: 339 and the VL of SEQ ID NO: 345.

13. The isolated protein claim 10, wherein the Fc region comprises at least one mutation that results in reduced binding of the protein to a Fcγ receptor (FcγR).

14. The isolated protein of claim 13, wherein the at least one mutation that results in reduced binding of the protein to the FcγR is L234A/L235A/D265S, wherein residue numbering is according to the EU index.

15. The isolated protein of claim 10, wherein the protein comprises at least one mutation in the Fc domain, wherein the mutation promotes heavy chain heterodimerization.

16. The isolated protein of claim 15, wherein the at least one mutation in the Fc domain is selected from the group consisting of T350V/L351Y/F405A/Y407V and T350V/T366L/K392L/T394W, wherein residue numbering is according to the EU index.

17. A pharmaceutical composition comprising the isolated protein of claim 1 and a pharmaceutically acceptable carrier.

18. A polynucleotide encoding the isolated protein of claim 1.

19. A vector comprising the polynucleotide of claim 18.

20. A host cell comprising the vector of claim 19.

21. A method of producing the isolated protein of claim 1, comprising culturing the host cell of claim 20 in conditions that the protein is expressed, and recovering the protein produced by the host cell.

22. A method of treating a HLA-G expressing cancer in a subject, comprising administering a therapeutically effective amount of the isolated protein of claim 1 to the subject for a time sufficient to treat the HLA-G expressing cancer.

23. A method of reducing the amount of HLA-G expressing tumor cells in a subject, comprising administering the isolated protein of claim 1 to the subject for a time sufficient to reduce the amount of HLA-G expressing tumor cells.

24. The method of claim 22, wherein the HLA-G expressing cancer is a lung cancer, a pancreatic cancer, a renal cancer, a head and neck cancer, an ovarian cancer, an esophageal cancer, a colorectal cancer, a uterine cancer, or a breast cancer.

25. An isolated protein of claim 1 comprising an amino acid sequence of SEQ ID NO: 478.

26. The isolated protein of claim 25 comprising an amino acid sequence of SEQ ID NO: 490.

27. The isolated protein of claim 25 further comprising amino acid sequences of SEQ ID NOs: 489 and 447.

28. The isolated protein of claim 27 further comprising an amino acid sequence of SEQ ID NO: 439.

* * * * *